(12) United States Patent  
Schwartz et al.

(10) Patent No.: US 8,137,928 B2  
(45) Date of Patent: Mar. 20, 2012

(54) EXPRESSION OF SOLUBLE, ACTIVE EUKARYOTIC GLYCOSYLTRANSFERASES IN PROKARYOTIC ORGANISMS

(75) Inventors: Marc F. Schwartz, West Windsor, NJ (US); Tarik Soliman, Chester Springs, PA (US)

(73) Assignee: BioGeneriX, Mannheim (DE)

( * ) Notice: Subject to any disclaimer, the term of this patent is extended or adjusted under 35 U.S.C. 154(b) by 0 days.

(21) Appl. No.: 11/388,595

(22) Filed: Mar. 24, 2006

(65) Prior Publication Data

US 2006/0234345 A1    Oct. 19, 2006

Related U.S. Application Data

(60) Provisional application No. 60/665,396, filed on Mar. 24, 2005, provisional application No. 60/668,899, filed on Apr. 5, 2005, provisional application No. 60/732,409, filed on Oct. 31, 2005.

(51) Int. Cl.
| | |
|---|---|
| C12P 21/06 | (2006.01) |
| C12N 9/10 | (2006.01) |
| C12N 1/20 | (2006.01) |
| C12N 1/00 | (2006.01) |
| C07H 21/04 | (2006.01) |

(52) U.S. Cl. .......... 435/69.1; 435/193; 435/252.3; 435/254.1; 536/23.1; 536/23.2; 536/23.4

(58) Field of Classification Search .......... 435/69.1, 435/193, 252.3, 254.1; 536/23.1, 23.2, 23.4
See application file for complete search history.

(56) References Cited

U.S. PATENT DOCUMENTS

| | | | | |
|---|---|---|---|---|
| 5,858,751 | A * | 1/1999 | Paulson et al. | 435/193 |
| 6,027,888 | A | 2/2000 | Georgiou et al. | |
| 6,159,708 | A * | 12/2000 | Sogo et al. | 435/69.1 |
| 6,037,730 | A1 | 5/2002 | Bayer et al. | |
| 6,387,683 | B1 * | 5/2002 | Ishii et al. | 435/233 |
| 6,399,336 | B1 | 6/2002 | Paulson et al. | |
| 7,179,617 | B2 | 2/2007 | DeFrees et al. | |
| 7,416,858 | B2 | 8/2008 | DeFrees et al. | |
| 2002/0142386 | A1 | 10/2002 | Betenbaugh | |
| 2003/0186850 | A1 * | 10/2003 | Clausen et al. | 514/8 |
| 2003/0219870 | A1 * | 11/2003 | Georgiou et al. | 435/69.1 |
| 2005/0100982 | A1 | 5/2005 | DeFrees et al. | |
| 2005/0106658 | A1 | 5/2005 | DeFrees et al. | |
| 2005/0287637 | A1 | 12/2005 | Betenbaugh et al. | |
| 2010/0143969 | A1 | 6/2010 | Schwartz et al. | |

FOREIGN PATENT DOCUMENTS

| | | |
|---|---|---|
| EP | 0786382 B1 | 3/2003 |
| EP | 0786009 B1 | 3/2006 |
| JP | 11-137247 A | 5/1999 |
| JP | 11-253163 A | 9/1999 |
| JP | 2001-178453 A | 7/2001 |
| JP | 2004-16116 A | 1/2004 |
| JP | 2004-16117 A | 1/2004 |
| JP | 2005-46030 A | 2/2005 |
| JP | 2005-46031 A | 2/2005 |
| WO | WO 03/093448 A2 * | 11/2003 |
| WO | WO 2003/093448 A2 | 11/2003 |
| WO | WO 2004/106508 A2 | 12/2004 |
| WO | 2005/089102 A1 | 9/2005 |
| WO | WO 2005/089102 A2 | 9/2005 |

OTHER PUBLICATIONS

Sorensen et al., Soluble expresion of recombinant proteins in the cytoplasm of *Escherichia coli*. Microbial Cell Factories, 2005, vol. 4: 1-8 (published on line Jan. 4, 2005) (in IDS).*
Levy et al., Production of correctly folded Fab antibody fragment in the cytoplasm of *Escherichia coli* trxB gor mutants via the coexpression of molecular chaperones. Protein Expresion and Purification, 2001, vol. 23: 338-347 (in IDS).*
Bencur et al., *Arabidopsis thaliana* b1, 2-xylosyltransferase: an unusual glycosyltransferase with the potential to act at multiple stages of the plant N-glycosylation pathway. Biochem. J., 2005, vol. 388: 515-525.*
Whisstock et al., Prediction of protein function from protein sequence. Q. Rev. Biophysics., 2003, vol. 36 (3): 307-340.*
Haraguchi et al, The effects of the site-directed removal of N-glycosylation sites from β-1,4-N-acetylgalactosaminyltransferase on its function, J. BioChem, 1995, 273-80, vol. 312, Great Britain.
Jeanneaut et al., Structure-Function Analysis of the Human Sialyltransferase ST3Gal I, J. BioChem, 2004, 13461-68, vol. 279, Issue 14, America Society of BioChem and Mol Biol, Inc. USA.
Kumar et al, Cloning and expression of N-acetylglucosaminyltransferase I, the medial Golgi transferase that initiates complex N-linked carbohydrate formation, Proc Natl Acad Sci, 1990, 9948-52, vol. 87, Medical Sciences, USA.
Mueller et al., Characterization of mucin-type core-1 β1-3 galactosyltransferase homologous enzymes in *Drosophila melanogaster*, FEBS Journal, 2005, 4295-4305, 272.
Uemura et al., Substitution of the N-glycan function in glycosyltransferases by specific amino acids: ST3Gal-V as model enzyme, Glycobiology, 2006, 258-270, vol. 16, Issue 3, Oxford University Press.
U.S. Appl. No. 11/909,599, Schwartz et al.
Bach, Horacio et al.; "*Escherichia coli* Maltose-binding Protein as a Molecular Chaperone for Recombinant Intracellular Cytoplasmic Single-chain Antibodies"; 2001, *J. Mol. Bio.*, vol. 312, pp. 79-93.
Bennett, Eric Paul et al.; "cDNA Cloning and Expression of a Novel Human UDP-N-acetyl-α-D-galactosamine", 1996, *The Journal of Biological Chemistry*, vol. 271, No. 29, pp. 17006-17012.
Bennett, Eric Paul et al.; "Genomic organization and chromosomal localization of three members of the UDP-N-Acetylglucosaminyltransferase: polypeptide N-Acetylglucosaminyltransferase family"; 1998, *Glycobiology*, vol. 8, No. 6, pp. 547-555.
Boeggeman, Elizabeth E. et al.; "Expression of deletion constructs of bovine β-1,4-galactosyltransferase in *Escherichia coli*: importance of Cys134 for its activity"; 1993, *Protein Engineering*, vol. 6, No. 7, pp. 779-785.
Boeggeman, Elizabeth E. et al.; "Studies on the metal binding sites in the catalytic domain of β1,4-galactosyltransferase"; 2002, *Glycobiology*, vol. 12, No. 5, pp. 1-13.

(Continued)

*Primary Examiner* — Ganapathirama Raghu
(74) *Attorney, Agent, or Firm* — Leydig, Voit & Mayer, Ltd.

(57) ABSTRACT

The present invention provides enhanced methods of producing soluble, active eukaryotic glycosyltransferases in prokaryotic microorganisms that have an oxidizing environment.

5 Claims, 10 Drawing Sheets

OTHER PUBLICATIONS

Chen, Chun et al.; "Minimal structure and glycosylation requirements for ST6Gal I activity and trafficking"; 2000, *Glycobiology*, vol. 10, No. 5, pp. 531-583.

Chen, Chun et al.; "Formation of Insoluble Oligomers Correlates with ST6Gal I Staple Localization in the Golgi"; 2000, *The Journal of Biological Chemistry*, vol. 275, No. 18, pp. 13819-13826.

Chen, Wei et al.; "Independent Lec1A CHO Glycosylation Mutants Arise from Point Mutations in N- Acetylglucosaminyltransferase I That Reduce Affinity for Both Substrates. Molecular Consequences Based on the Crystal Structure of GlcNAc-TI"; 2001, *Biochemistry*, vol. 40, pp. 8765-8772.

Chen, Wei et al.; "Five Lec1 CHO cell mutants have distinct *Mgat1* gene mutations that encode truncated N-acetylglucosaminyltransferase I"; 2003, *Glycobiology*, vol. 13, No. 1, pp. 43-50.

Clark, Eliana De Bernardez; "Protein refolding for industrial processes"; 2001, *Current Opinion in Biotechnology*, vol. 12, pp. 202-207.

Coffman, Birgit L. et al.; "Analysis of Opioid Binding to UDP-Glucuronosyltransferase 2B7 Fusion Proteins Using Nuclear Magnetic Resonance Spectroscopy"; 2001, *Molecular Pharmacology*, vol. 59, No. 6, pp. 1464-1469.

Colland, Frederic et al.; Functional Proteomics Mapping of a Human Signaling Pathway; 2004, *Genome Research*, vol. 14, pp. 1324-1332.

Collet, Jean-Francois et al.; "Oxidative protein folding in bacteria"; 2002, *Molecular Microbiology*, vol. 44, No. 1, pp. 1-8.

Collins, Francis S.; "Generation and initial analysis of more that 15,000 full-length human and mouse cDNA sequences"; 2002, *PNAS*, vol. 99, No. 26, pp. 16899-16903.

D'Agostaro, Giacomo et al.; "Cloning of cDNA encoding the membrane-bound form of bovine β1,4-galactosyltransferase"; 1989, *Eur. J. Biochem.*, vol. 183, pp. 211-217.

El-Battari, Assou et al.; "Different glycosyltransferases are differentially processed for secretion, dimerization, and autoglycosylation"; 2003, *Glycobiology*, vol. 13, No. 12, pp. 941-953.

Fujiyama, Kazuhito et al.; "Human N-Acetylglucosaminyltransferase I. Expression *Escherichia coli* as a Soluble Enzyme, and Application as an Immobilized Enzyme for the Chemoenzymatic Synthesis of N-Linked Oligosaccharides"; 2001, *The Journal of Bioscience and Bioengineering*, vol. 92, No. 6, pp. 569-574.

Lee, Young-Choon et al.; "Molecular Cloning and Functional Expression of Two Members of Mouse NeuAcα2,3Galβ1,3GalNAc GalNAcα2,6-Sialytransferase Family, ST6GalNAc III and IV"; 1999, *The Journal of Biological Chemistry*, vol. 274, No. 17, pp. 11958-11967.

Fujiyama, Kazuhito et al; "Human N-Acetylglucosaminyltransferase I. Expression in *Escherichia coli* as a Soluble Enzyme, and Application as an Immobilized Enzyme for the Chemoenzymatic Synthesis of N-Linked Oligosaccharides"; 2001, *Journal of Bioscience and Bioengineering*, vol. 92, No. 6, pp. 569-574.

Gillespie, William et al.; "Cloning and Expression of the Galβ1,3GalNAc α2,3-Sialytransferase"; 1992, *The Journal of Biological Chemistry*, vol. 267, No. 29, pp. 21004-21010.

Hellman, Jukka et al.; "In Vitro Refolding of Cyclomaltodextrin Glucanotransferase from Cytoplasmic Inclusion Bodies Formed upon Expression in *Escherichia coli*"; 1995, *Protein Expression and Purification*, vol. 6, pp. 56-62.

Ju, Tongzhong et al.; "Cloning and Expression of Human Core 1 β1,3-Galactosyltransferase"; 2002, *The Journal of Biological Chemistry*, vol. 277, No. 1, pp. 178-186.

Kamar, Maria et al.; "Analysis of the site-specific N-glycosylation of β1,6 N-Acetylglucosaminyltransferase V"; 2004, *Glycobiology*, vol. 14, No. 7, pp. 583-592.

Kapust, Rachel B. et al.; "*Escherichia coli* maltose-binding protein is uncommonly effective at promoting the solubility of polypeptides to which it is fused", 1999, *Protein Science*, vol. 8, pp. 1668-1674.

Koprivova, A. et al.; "N-Glycosylation in the Moss *Physcomitrella patens* is Organized Similarly to that in Higher Plants"; 2003, *Plant Biology*, vol. 5, pp. 582-591.

Kurosawa, Nobuyuki et al.; "Molecular Cloning and Genomic Analysis of Mouse GalNAc α2,6-Sialytransferase (ST6GalNAc I)"; 2000, *J. Biochem.*, vol. 127, pp. 845-854.

Levy, Raphael et al.; "Production of Correctly Folded Fab Antibody Fragment in the Cytoplasm of *Escherichia coli trxB gor* Mutants via the Coexpression of Molecular Chaperones"; 2001, *Protein Expression and Purification*, vol. 23, pp. 338-347.

Lubas, William A. et al.; "Functional Expression of O-linked GlcNAc Transferase"; 2000, *The Journal of Biological Chemistry*, vol. 275, No. 15, pp. 10983-10988.

Mucha, Jan et al.; "Tissues of the clawed frog *Xenopus laevis* contain two closely related forms of UDP-GlcNAc:α3-D-mannoside β-1,2-N-Acetylglucosaminyltransferase I"; 2001, *Glycobiology*, vol. 11, No. 9, pp. 769-778.

Muhlenhoff, Martina et al.; "The Impact of N-Glycosylation on the Functions of Polysialytransferases"; 2001, *The Journal of Biological Chemistry*, vol. 276, No. 36, pp. 34066-34073.

Nagai, Kaoru et al.; "N-Glycosylation is requisite for the enzyme activity and Golgi retention of N-Acetylglucosaminyltransferase III"; 1997, *Glycobiology*, vol. 7, No. 6, pp. 769-776.

Nishiu, Jun et al.; "Characterization of Rat N-Acetylglucosaminyltransferase I Expressed in *Escherichia coli*"; 1995, *Biosci. Biotech. Biochem.*, vol. 59, No. 9, pp. 1750-1752.

Nozaki, Hirofumi et al.; "Are there two forms of β2-N-Acetylglucosaminyltransferase I in rat testicular and epididymal fluids"; 2003, *Biochimica et Biophysica Acta*, vol. 1649, pp. 140-145.

Opat, Andrew S. et al.: "Genetic defect in N-Acetylglucosaminyltransferase I gene of a ricin-resistant baby hamster kidney mutant"; 1998, *Biochem. J.*, vol. 336, pp. 593-598.

Puthalakath, Hamsa et al.; "Glycosylation Defect in Lec1 Chinese Hamster Ovary Mutant Is Due to a Point Mutation in N-Acetylglucosaminyltransferase I Gene"; 1996, *The Journal of Biological Chemistry*, vol. 271, No. 44, pp. 27818-27822.

Quesneville, Hadi et al.; "Combined Evidence Annotation of Transposable Elements in Genome Sequences"; 2005, *PLoS Computational Biology*, vol. 1, No. 2, pp. 166-175.

Ramakrishnan, Boopathy et al.; "α-Lactalbumin (LA) Stimulates Milk β-1,4-Galactosyltransferase I (β4Gal-T1) to Transfer Glucose from UDP-glucose to N-Acetylglucosamine"; 2001, *The Journal of Biological Chemistry*, vol. 276, No. 40. pp. 37665-37671.

Ramakrishnan, Boopathy et al.; "Structure-based Design of β1,4-Galactosyltransferase I (β4Gal-T1) with Equally Efficient N-Acetylglucosaminyltransferase Activity"; 2002, *The Journal of Biological Chemistry*, vol. 277, No. 23, pp. 20833-20839.

Sarkar, M. et al.; "Removal of 106 amino acids from the N-terminus of UDP-GlcNAc: α-3-D-mannoside β-1,2-N-Acetylglucosaminyltransferase I does not inactivate the enzyme"; 1998, *Glycoconjugate Journal*, vol. 15, pp. 193-197.

Sarkar, M. et al.; "Molecular cloning and expression of cDNA encoding the enzyme that controls conversion of high-mannose to hybrid and complex N-glycans: UDP N-Acetylglucosaminyltransferase: α-3-D-mannoside β-1,2 N-Acetylglucosaminyltransferase I"; 1991, *PNAS*, vol. 88, pp. 234-238.

Sasaki, Katsutoshi et al.; "Expression Cloning of a Novel Galβ(1-3/1-4)GlcNAc α2,3-Sialytransferase Using Lectin Resistance Selection"; 1993, *The Journal of Biological Chemistry*, vol. 268, No. 30, pp. 22782-22787.

Seto, Nina O.L. et al.; "Expression of a recombinant human glycosyltransferase from a synthetic gene and its utilization for synthesis of the human blood group B trisaccharide"; 1995, *Eur. J. Biochem.*, vol. 234, pp. 323-328.

Seto, Nina O.L. et al.; "Donor substrate specificity of recombinant human blood group A, B and hybrid A/B glycosyltransferases expressed in *Escherichia coli*"; 1999, *Eur. J. Biochem.*, vol. 259, pp. 770-775.

Shah, Premal S. et al.; "Active site studies of bovine α1-3-galactosyltransferase and its secondary structure prediction"; 2000, *Biochimica et Biophysica Acta*, vol. 1480, pp. 222-234.

Shang, Jie et al.; "Molecular cloning and expression of Galβ1,3GalNAc α2,3-sialytransferase from human fetal liver"; 1999, *Eur. J. Biochem.*, vol. 265, pp. 580-588.

Sorensen, Hans Peter et al.; "Soluble expression of recombinant proteins in the cytoplasm of *Escherichia coli*"; 2005, *Microbial Cell Factories*, vol. 4, No. 1, 8 pages.

Tenno, Mari et al.; "Identification of two cysteine residues involved in the binding of UDP-GalNAc to UDP-GalNAc:polypeptide N-Acetylglucosaminyltransferase I (GalNAc-T1)"; 2002, *Eur. J. Biochem.*, vol. 269, pp. 4308-4316.

Unligil, Ulig M. et al.; "X-ray crystal structure of rabbit N-Acetylglucosaminyltransferase I: catalytic mechanism and a new protein superfamily"; 2000, *The EMBO Journal*, vol. 19, No. 20, pp. 5269-5280.

Uehara, Kazuyoshi et al.; "Molecular cloning and characterization of β-1,4 galactosyltransferase expressed in mouse testis"; 1997, *Eur. J. Biochem.*, vol. 244, pp. 706-712.

Uemura, Satoshi et al.; "Substitution of the N-glycan function in glycosyltransferases by specific amino acids: ST3Gal-V as a model enzyme"; 2006, *Glycobioloqy*, vol. 16, No. 3, pp. 258-270.

Yang, Xiaojing et al.; "Soluble human core 2 β6-N-Acetylglucosaminyltransferase C2GnT1 requires its conserved cysteine residues for full activity"; 2003, *Biochimica et Biophysica Acta*, vol. 1648, pp. 62-74.

Wen, Dawn X. et al.; "Primary Structure of Galβ1,3(4)GlcNAc α2,3-Sialyltransferase Determined by Mass Spectrometry Sequence Analysis and Molecular Cloning"; 1992, *The Journal of Biological Chemistry*, vol. 267, No. 29, pp. 21011-21019.

White, Thayer et al.: "Purification and cDNA Cloning of a Human UDP-N-acetyl-α-D-galactosamine:polypeptide N-Acetylglucosaminyltransferase"; 1995, *The Journal of Biological Chemistry*, vol. 270, No. 41, pp. 24156-24165.

Wong, Chi-Huey; "Carbohydrate-based Drug Discovery"; 2003, *The Scripps Research Institute*, pp. 129-136.

"FoldIt Screen: User Guide"; 2000, *Hampton Research*, 6 pages.
NCBI accession XM 315359.3, 2 pages, Jun. 13, 2007.
NCBI accession NM 065318.2, 2 pages, Jun. 13, 2007.
NCBI accession AJ249878.1, 2 pages, Jun. 13, 2007.
NCBI accession AJ249883.1, 2 pages, Jun. 13, 2007.
NCBI accession AJ295993.1, 2 pages, Jun. 13, 2007.
NCBI accession NM 119986.3, 2 pages, Jun. 13, 2007.
"Novagen pET System Manual"; 2003, 10th Edition Rev. B 0403, 68 pages, Mar. 24, 2005.

"Novagen: 71352: Rosetta-gami™ 2(DE3)pLysS Competent Cells"; http://www.emdbiosciences.com/product/print/71352, 2 pages, Mar. 24, 2005.

"Novagen: 71431: Origami™ 2 Competent Cell Set"; http://www.emdbiosciences.com/product/71431, 2 pages, Mar. 24, 2005.

De Marco, "Strategies for Successful Recombinant Expression of Disulfide Bond-Dependent Proteins in *Escherichia coli*," *Microbial Cell Factories*, 8(26): 1-18 (2009).

Humphreys et al., "Co-expression of Human Protein Disulphide Isomerase (PDI) Can Increase the Yield of an Antibody Fab' Fragment Expressed in *Escherichia coli*," *FEBS Letters*, 380: 194-197 (1996).

National Center for Biotechnology Information, GenBank Accession No. AAA31125.1 (accessed Jul. 14, 2011).
National Center for Biotechnology Information, GenBank Accession No. AAA52563.1 (accessed Jul. 14, 2011).
National Center for Biotechnology Information, GenBank Accession No. AAF52725.1 (accessed Jul. 14, 2011).
National Center for Biotechnology Information, NCBI Accession No. NP_004472.1 (accessed Jul. 14, 2011).
National Center for Biotechnology Information, NCBI Accession No. NP_060884.1 (accessed Jul. 14, 2011).
National Center for Biotechnology Information, NCBI Accession No. NP_113885.1 (accessed Jul. 14, 2011).

Ohnuma et al., "Molecular Cloning, Functional Expression, and Mutagenesis of cDNA Encoding Class I Chitinase from Rye (*Secale cereale*) Seeds," *Biosci. Biotechnol. Biochem.*, 68: 324-332 (2004).

Shibatani et al., "Production and Characterization of Active Soluble Human β-1,4-Galactosyltransferease in *Escherichia coli* as a Useful Catalyst in Synthesis of the Gal β1→4 GlcNAc Linkage," *J. Bioscience and Bioengineering*, 91(1): 85-87 (2001).

Singh et al., "Solubilization and Refolding of Bacterial Inclusion Body Proteins," *J. Biosci. Bioeng.*, 99(4): 303-310 (2005).

Skretas et al., "Expression of Active Human Sialyltransferase ST6GalNAcI in *Escherichia coli*," *Microbial Cell Factories*, 8(50): 1-11 (2009).

* cited by examiner

EXPRESSION OF SOLUBLE, ACTIVE EUKARYOTIC GLYCOSYLTRANSFERASES IN PROKARYOTIC ORGANISMS

CROSS-REFERENCES TO RELATED APPLICATIONS

This application claims priority, under 35 USC Section 119(e), of U.S. Provisional Application No. 60/665,396, filed Mar. 24, 2005; of U. S. Provisional Application No. 60/668,899, filed Apr. 5, 2005; and of U. S. Provisional Application No. 60/732,409, filed Oct. 31, 2005; each of which are herein incorporated by reference for all purposes.

STATEMENT AS TO RIGHTS TO INVENTIONS MADE UNDER FEDERALLY SPONSORED RESEARCH AND DEVELOPMENT

NOT APPLICABLE

FIELD OF INVENTION

The present invention provides enhanced methods of producing soluble, active eukaryotic glycosyltransferases in prokaryotic microorganisms that have an oxidizing environment.

BACKGROUND OF THE INVENTION

Eukaryotic organisms synthesize oligosaccharide structures or glycoconjugates, such as glycolipids or glycoproteins, that are commercially and therapeutically useful. In vitro synthesis of oligosaccharides or glycoconjugates can be carried out using recombinant eukaryotic glycosyltransferases. The most efficient method to produce many recombinant proteins is to express the protein in bacteria. However, in bacteria, many eukaryotic glycosyltransferases are expressed as insoluble proteins in bacterial inclusion bodies, and yields of active eukaryotic glycosyltransferase protein from the inclusion bodies can be very low. In addition, many eukaryotic glycosyltransferases are expressed as glycosylated proteins in their cells of origin. Therefore, it was believed that expression of the proteins in bacteria would not include native glycosylation patterns, further decreasing the expectation of expression of active eukaryotic glycosyltransferase protein. See, e.g., Breton et al., *Biochimie* 83:713-718 (2001). Thus, there is a need for improved methods to produce enzymatically active eukaryotic glycosyltransferases in prokaryotic organisms, such as, e.g., bacteria. The present invention solves this and other needs.

BRIEF SUMMARY OF THE INVENTION

In one aspect, the present invention provides a method of producing a soluble eukaryotic glycosyltransferase in a prokaryotic microorganism that has an oxidizing environment, by a) expressing a nucleic acid that encodes the eukaryotic glycosyltransferase in the prokaryotic microorganism; and then b) growing the prokaryotic microorganism under conditions that allow expression of the soluble active eukaryotic glycosyltransferase within a cellular compartment of prokaryotic microorganism.

In one embodiment, the eukaryotic glycosyltransferase is a member selected from a eukaryotic N-acetylglucosaminyltransferase I (GnT or GNT), a eukaryotic N-acetylgalactosaminyltransferase (GalNAcT), a eukaryotic galactosyltransferase (GalT), and a eukaryotic sialyltransferase. Examples of each of these classes of enzymes include, e.g., for a eukaryotic N-acetylglucosaminyltransferase GnT1, BGnT-1, GnT-II, GnT-III, GnT-IV (e.g., GnT-IVa and GnT-IVb), GnT-V, GnT-VI, GnT-IVH, MGNTI, and OGT proteins; for a eukaryotic N-acetylgalactosaminyltransferase GalNAc-T2, GalNAc-T1, and GalNAc-T3 proteins; for a eukaryotic galactosyltransferase (GalT) a eukaryotic β-1,4-galactosyltransferase (GalT1) or a eukaryotic core I galactosyltransferase (Core 1 GalT 1); for a eukaryotic sialyltransferase, a eukaryotic α(2,3)sialyltransferase (ST3Gal3), a eukaryotic α-N-acetylgalactosaminide α-2,6-sialyltransferase I (ST6GalNAcT1), or a eukaryotic gal β1,3GalNAc α2,3-sialyltransferase (ST3GalI).

Some preferred examples of eukaryotic glycosyltransferases for use in the invention include a eukaryotic N-acetylglucosaminyltransferase I (GnT1 or GNTI), a eukaryotic N-acetylgalactosaminyltransferase (GalNAcT), e.g., a GalNAcT1, GalNAcT2, or GalNAcT3, a eukaryotic β-1,4-galactosyltransferase (GalT1), a eukaryotic α-2,3-sialyltransferase (ST3Gal3), a eukaryotic α-N-acetylgalactosaminide α-2,6-sialyltransferase I (ST6GalNAc-1), a eukaryotic gal β1,3GalNAc α2,3-sialyltransferase (ST3Gal-1), and a eukaryotic core 1 galactosyltransferase (Core-1-GalT-1).

In a first embodiment the prokaryotic microorganism is an *E. coli* or a *Pseudomonas* bacterium that has an oxidizing environment. For example, the *E. coli* can be manipulated to inactivate endogenous or genomic reductase nucleic acids, e.g., a trxB gene and a gor gene. Other *E. coli* strains that can be used include, e.g., a trxB gor supp mutant strain or a trxB gshA supp mutant strain, both of which are disclosed in U.S. Pat. No. 6,872,563, which is herein incorporated by reference for all purposes. In a further embodiment the prokaryotic microorganism, e.g., *E. coli* cells or *Pseudomonas* cells are grown at a temperature between 12-30° C. while the eukaryotic glycosyltransferase is expressed. The prokaryotic microorganism can also express additional proteins to enhance solubility of the eukaryotic glycosyltransferase, e.g. a heterologous protein disulfide isomerase (PDI) or a heterologous chaperone protein, or both a heterologous PDI and a heterologous chaperone protein.

In another embodiment, the method further comprises the step of isolating the eukaryotic glycosyltransferase. In additional embodiments, the eukaryotic glycosyltransferase comprises a purification tag, e.g., a maltose binding protein domain or a starch binding protein domain. In additional embodiments, the soluble eukaryotic glycosyltransferase is produced on a commercial scale. Commercial scale includes preparation of a sufficient amount of enzyme to produce a glycosylated product on a commercial (microgram, milligram, or gram) scale.

In another aspect, the present invention provides a soluble active eukaryotic glycosyltransferase produced in a prokaryotic microorganism that has an oxidizing environment. In one preferred embodiment the soluble active eukaryotic glycosyltransferase is intracellularly expressed in the prokaryotic microorganism. In a further embodiment, the soluble active eukaryotic glycosyltransferase is unglycosylated or has a different or minimal; glycosylation pattern, when compared to the same eukaryotic glycosyltransferase expressed in a eukaryotic cell, e.g. a mammalian cell, a yeast cell, or a cell of origin, (i.e., a human cell for a human glycosyltransferase). It is preferred that the unglycosylated, differently or minimally glycosylated eukaryotic glycosyltransferase has enzymatic activity.

In a further aspect, the invention provides an in vitro method of producing an oligosaccharide, by contacting an acceptor substrate with a donor substrate and the soluble eukaryotic glycosyltransferase of the preceding paragraph, under conditions that allow production of the oligosaccharide. In some embodiments, the acceptor substrate is attached to e.g., a glycolipid, a glycoprotein, a glycopeptide, a protein, or a peptide. In one embodiment the glycoprotein, glycopeptide, protein, or peptide is a therapeutic protein. Therapeutic proteins include, e.g., the proteins listed in Table 2. In another embodiment, the oligosaccharide is isolated. In a further embodiment, the oligosaccharide is produced on a commercial scale.

BRIEF DESCRIPTION OF THE DRAWINGS

FIG. 6 demonstrates the glycosylation of interferon-alpha-2b using eukaryotic glycosyltransferases produced in trxB gor supp mutant E. coli. Reaction products were analyzed by MALDI TOF mass spectrometry.

DEFINITIONS

Figure 1:
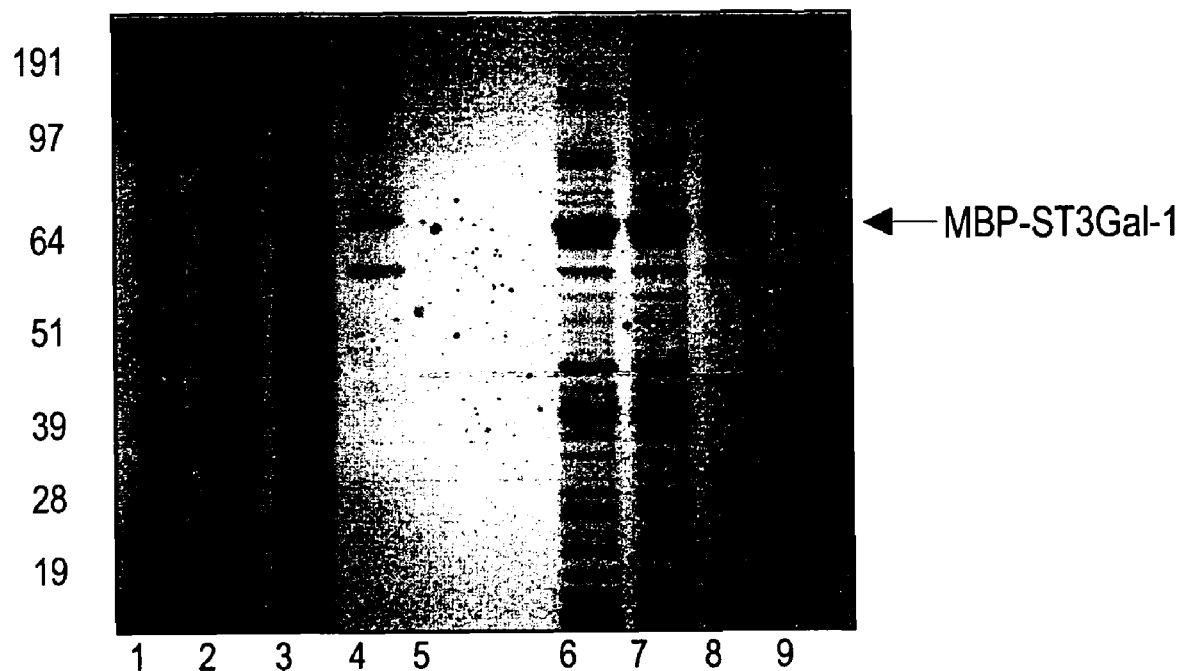
FIG. 1 demonstrates SDS-PAGE analysis of the expression and partial purification of soluble MBP-tagged truncated porcine ST3Gal-1. MBP-ST3Gal-1 was expressed in JM109 (lanes 2-5) and trxB gor supp mutant (lanes 6-9) strains. Lanes 2-3 and 6-7 are clarified lysate before and after incubation with amylose resin, respectively. Lanes 4-5 and 8-9 are serial elutions from the amylose resin containing partially purified MBP-ST3Gal-1. The first lane is molecular weight markers.

The recombinant glycosyltransferase proteins produced by the methods of the invention are useful for transferring a saccharide from a donor substrate to an acceptor substrate. The addition generally takes place at the non-reducing end of an oligosaccharide or carbohydrate moiety on a biomolecule. Biomolecules as defined here include, but are not limited to, biologically significant molecules such as carbohydrates, proteins (e.g., glycoproteins), and lipids (e.g., glycolipids, phospholipids, sphingolipids and gangliosides).

The following abbreviations are used herein:
Ara=arabinosyl;
Fru=fructosyl;
Fuc=fucosyl;
Gal=galactosyl;
GalNAc=N-acetylgalactosylamino;
Glc=glucosyl;
GlcNAc=N-acetylglucosylamino;
Man=mannosyl; and
NeuAc=sialyl (N-acetylneuraminyl)
FT or FucT=fucosyltransferase*
ST=sialyltransferase*
GalT=galactosyltransferase*

Arabic or Roman numerals are used interchangeably herein according to the naming convention used in the art to indicate the identity of a specific glycosyltransferase (e.g., FTVII and FT7 refer to the same fucosyltransferase).

Oligosaccharides are considered to have a reducing end and a non-reducing end, whether or not the saccharide at the reducing end is in fact a reducing sugar. In accordance with accepted nomenclature, oligosaccharides are depicted herein with the non-reducing end on the left and the reducing end on the right.

The term "sialic acid" refers to any member of a family of nine-carbon carboxylated sugars. The most common member of the sialic acid family is N-acetyl-neuraminic acid (2-keto-5-acetamido-3,5-dideoxy-D-glycero-D-galactononulopyranos-1-onic acid (often abbreviated as Neu5Ac, NeuAc, or NANA). A second member of the family is N-glycolyl-neuraminic acid (Neu5Gc or NeuGc), in which the N-acetyl group of NeuAc is hydroxylated. A third sialic acid family member is 2-keto-3-deoxy-nonulosonic acid (KDN) (Nadano et al (1986) *J. Biol. Chem.* 261: 11550-11557; Kanamori et al., *J. Biol. Chem.* 265: 21811-21819 (1990)). Also included are 9-substituted sialic acids such as a 9-O—$C_1$-$C_6$ acyl-Neu5Ac like 9-O-lactyl-Neu5Ac or 9-O-acetyl-Neu5Ac, 9-deoxy-9-fluoro-Neu5Ac and 9-azido-9-deoxy-Neu5Ac. For review of the sialic acid family, see, e.g., Varki, *Glycobiology* 2: 25-40 (1992); *Sialic Acids: Chemistry, Metabolism and Function*, R. Schauer, Ed. (Springer-Verlag, New York (1992)). The synthesis and use of sialic acid compounds in a sialylation procedure is disclosed in international application WO 92/16640, published Oct. 1, 1992.

An "acceptor substrate" for a glycosyltransferase is an oligosaccharide moiety that can act as an acceptor for a particular glycosyltransferase. When the acceptor substrate is contacted with the corresponding glycosyltransferase and sugar donor substrate, and other necessary reaction mixture components, and the reaction mixture is incubated for a sufficient period of time, the glycosyltransferase transfers sugar residues from the sugar donor substrate to the acceptor substrate. The acceptor substrate will often vary for different types of a particular glycosyltransferase. For example, the acceptor substrate for a mammalian galactoside 2-L-fucosyltransferase ($\alpha$1,2-fucosyltransferase) will include a Gal$\beta$1,4-GlcNAc-R at a non-reducing terminus of an oligosaccharide; this fucosyltransferase attaches a fucose residue to the Gal via an $\alpha$1,2 linkage. Terminal Gal$\beta$1,4-GlcNAc-R and Gal$\beta$1,3-GlcNAc-R and sialylated analogs thereof are acceptor substrates for $\alpha$1,3 and $\alpha$1,4-fucosyltransferases, respectively. These enzymes, however, attach the fucose residue to the GlcNAc residue of the acceptor substrate. Accordingly, the term "acceptor substrate" is taken in context with the particular glycosyltransferase of interest for a particular application. Acceptor substrates for additional glycosyltransferases, are described herein. Acceptor substrates also include e.g., glycolipids, peptides, proteins, glycopeptides, glycoproteins and therapeutic proteins.

A "donor substrate" for glycosyltransferases is an activated nucleotide sugar. Such activated sugars generally consist of uridine, guanosine, and cytidine monophosphate derivatives of the sugars (UMP, GMP and CMP, respectively) or diphosphate derivatives of the sugars (UDP, GDP and CDP, respectively) in which the nucleoside monophosphate or diphosphate serves as a leaving group. For example, a donor substrate for fucosyltransferases is GDP-fucose. Donor substrates for sialyltransferases, for example, are activated sugar nucleotides comprising the desired sialic acid. For instance, in the case of NeuAc, the activated sugar is CMP-NeuAc. Other donor substrates include e.g., GDP mannose, UDP-galactose, UDP-N-acetylgalactosamine, CMP-NeuAc-PEG (also referred to as CMP-sialic acid-PEG), UDP-N-acetylglucosamine, UDP-glucose, UDP-glucorionic acid, and UDP-xylose. Sugars include, e.g., NeuAc, mannose, galactose, N-acetylgalactosamine, N-acetylglucosamine, glucose, glucorionic acid, and xylose. Bacterial, plant, and fungal systems can sometimes use other activated nucleotide sugars.

A "method of remodeling a protein, a peptide, a glycoprotein, or a glycopeptide" as used herein, refers to addition of a sugar residue to a protein, a peptide, a glycoprotein, or a glycopeptide using a glycosyltransferase. In a preferred embodiment, the sugar residue is covalently attached to a PEG molecule.

A "eukaryotic glycosyltransferase" as used herein refers to an enzyme that is derived from a eukaryotic organism and that catalyzes transfer of a sugar residue from a donor substrate, i.e., from an activated nucleotide sugar, to an acceptor substrate, e.g., an oligosaccharide, a glycolipid, a peptide, a protein, a glycopeptide, or a glycoprotein. In preferred embodiments, a eukaryotic glycosyltransferase transfers a sugar from a donor substrate, i.e., a nucleotide sugar, to a peptide, a protein, a glycopeptide, or a glycoprotein. In another preferred embodiment, a eukaryotic glycosyltransferase is a type II transmembrane glycosyltransferase. Unmodified type II transmembrane glycosyltransferases typically include an amino terminal cytoplasmic domain, a signal-anchor or transmembrane domain, a stem region, and a catalytic domain. See, e.g., Paulson and Colley, *J. Biol. Chem.* 264:17615-17618 (1989). A eukaryotic glycosyltransferase can be derived from an eukaryotic organism, e.g., a unicellular or multicellular eukaryotic organism, a plant, an invertebrate animal, such as *Drosophila* or *C. elegans*, a vertebrate animal, an amphibian or reptile, a mammal, a rodent, a primate, a human, a rabbit, a rat, a mouse, a cow, or a pig and so on. Examples of eukaryotic glycosyltransferases follow and are also found in the attached sequence listing.

A "eukaryotic sialyltransferase" as used herein, refers to a sialyltransferase derived from a eukaryotic organism. The enzyme catalyzes the transfer of a sialic acid moiety from a CMP-sialic acid donor to an acceptor molecule. Eukaryotic sialyltransferases can also be recognized by the presence of conserved structural motifs, e.g., a sialyl motif L and a sialyl motif S as described in Tsuji, *J. Biochem.* 120:1-13 (1996), which is herein incorporated by reference for all purposes. Additional sialyltransferase motifs, e.g., the very small (VS) motif and motif III, are described in Patel and Balaji, *Glycobiology*, 16:108-116 (2006), e-published Oct. 5, 2005, which is herein incorporated by reference for all purposes. Eukaryotic sialyltransferases include enzymes that form a variety of linkages including $\alpha \rightarrow 3$, $\alpha 2 \rightarrow 6$, $\alpha 2 \rightarrow 8$. Eukaryotic sialyltransferases transfer the sialic acid moiety to different acceptor sugars on an acceptor molecule, e.g., galactose, GalNAc, and another sialic acid molecule. Eukaryotic sialyltransferases that catalyze specific reaction, i.e., that are members of the ST3Gal, ST6Gal, ST6GalNAc, or ST8Sia families can be identified by the presence of amino acid residues conserved within those families. Such family-based conserved amino acid residues are disclosed at Patel and Balaji, *Glycobiology*, 16:108-116 (2006), e-published Oct. 5, 2005, which is herein incorporated by reference for all purposes. Examples of eukaryotic sialyltransferases follow and are also found in the attached sequence listing.

A "eukaryotic $\alpha$(2,3)sialyltransferase (ST3Gal3)" as used herein, refers to an $\alpha$(2,3)sialyltransferase isolated from a eukaryotic organism. This enzyme catalyzes the transfer of sialic acid to the Gal of a Gal$\beta$1,3GlcNAc, Gal$\beta$1,3GalNAc or Gal$\beta$1,4GlcNAc glycoside (see, e.g., Wen et al. (1992) *J.*

Biol. Chem. 267: 21011; Van den Eijnden et al. (1991) J. Biol. Chem. 256: 3159). The sialic acid is linked to a Gal with the formation of an α-linkage between the two saccharides. Bonding (linkage) between the saccharides is between the 2-position of NeuAc and the 3-position of Gal. Like other eukaryotic glycosyltransferases, ST3Gal3 enzymes have a transmembrane domain, a stem region, and a catalytic domain. This particular enzyme can be isolated from rat liver (Weinstein et al. (1982) J. Biol. Chem. 257: 13845); the human cDNA (Sasaki et al. (1993) J. Biol. Chem. 268: 22782-22787; Kitagawa & Paulson (1994) J. Biol. Chem. 269: 1394-1401) and genomic (Kitagawa et al. (1996) J. Biol. Chem. 271: 931-938) DNA sequences are known, facilitating production of this enzyme by recombinant expression. Rat ST3Gal3 has been cloned and the sequence is known. See, e.g., Wen et al., J. Biol. Chem. 267:21011-21019 (1992) and Accession number M97754, each of which are herein incorporated by reference. Exemplary ST3Gal3 proteins are disclosed at, e.g., SEQ ID NOs:22-32.

A "eukaryotic α-N-acetylgalactosaminide α-2,6-sialyltransferase I (ST6GalNAcT1 or ST6GalNAc-1) as used herein, refers to an α(2,6)sialyltransferase isolated from a eukaryotic organism. The enzyme catalyzes the transfer of sialic acid from a CMP-sialic acid donor to an acceptor molecule. The transfer is an α2,6-linkage to N-acetylgalactosamine-O-Thr/Ser. Like other eukaryotic glycosyltransferases, ST6GalNAcT1 enzymes have a transmembrane domain, a stem region, and a catalytic domain. A number of ST6GalNAcT1 enzymes have been isolated and characterized, e.g., the full length mouse sequence, Kurosawa et al., J. Biochem. 127:845-854 (2000) and accession number JC7248, each of which is herein incorporated by reference. Exemplary ST6GalNAc-1 proteins are disclosed at, e.g., SEQ ID NOs:62-77.

A "eukaryotic Gal β1,3GalNAc α2,3-sialyltransferase (ST3GalI or ST3Gal-1)" as used herein, refers to a Gal β1,3GalNAc α2,3-sialyltransferase isolated from a eukaryotic organism. The enzyme catalyzes the transfer of sialic acid from a CMP-sialic acid donor to an acceptor molecule. The transfer is an α2,3-linkage to N-acetylgalactosamine-O-Thr/Ser. Like other eukaryotic glycosyltransferases, ST3GalI enzymes have a transmembrane domain, a stem region, and a catalytic domain. A number of ST3GalI enzymes have been isolated and characterized, e.g., the full length porcine sequence, Gillespie et al., J. Biol. Chem. 267:21004-21010 (1992) and accession number A45073, each of which are herein incorporated by reference. Exemplary ST3Gal-1 proteins are disclosed at, e.g., SEQ ID NOs:53-61.

Other sialyltransferases that can be used in the present invention include, e.g., "eukaryotic beta galactoside alpha 2,6-sialyltransferase (ST6Gal I) proteins. Exemplary ST6Gal 1 proteins are disclosed at, e.g., SEQ ID NOs:78-82.

Eukaryotic sialyltransferase proteins used in the invention also include alpha 2,8 sialyltransferase proteins, e.g., ST8Sia I, ST8Sia II, ST8Sia III, and ST8Sia IV. Examples of these sialyltransferase proteins are found, e.g., at SEQ ID NOs:83-97.

A "eukaryotic N-acetylglucosaminyltransferase" as used herein, refers to an N-acetylglucosaminyltransferase derived from a eukaryotic organism. The enzyme catalyzes the transfer of N-acetylglucosamine (GlcNAc) from a UDP-GlcNAc donor to an acceptor molecule. Like other eukaryotic glycosyltransferases, N-acetylglucosaminyltransferase has a transmembrane domain, a stem region, and a catalytic domain. Examples of eukaryotic N-acetylglucosaminyltransferases follow and are also found in the attached sequence listing.

A "eukaryotic β-1,2-N-acetylglucosaminyltransferase I (GnTI or GNTI)" as used herein, refers to a β-1,2-N-acetylglucosaminyltransferase I derived from a eukaryotic organism. Like other eukaryotic glycosyltransferases, GnTI has a transmembrane domain, a stem region, and a catalytic domain. Eukaryotic GnT1 proteins include, e.g., human, accession number NP_002397; Chinese hamster, accession number AAK61868; rabbit, accession number AAA31493; rat, accession number NP_110488; golden hamster, accession number AAD04130; mouse, accession number P27808; zebrafish, accession number AAH58297; Xenopus, accession number CAC51119; Drosophila, accession number NP_525117; Anopheles, accession number XP_315359; C. elegans, accession number NP_497719; Physcomitrella patens, accession number CAD22107; Solanum tuberosum, accession number CAC80697; Nicotiana tabacum, accession number CAC80702; Oryza sativa, accession number CAD30022; Nicotiana benthamiana, accession number CAC82507; and Arabidopsis thaliana, accession number NP_195537, each of which are herein incorporated by reference. Exemplary GnT1 proteins are disclosed at, e.g., SEQ ID NOs:1-11. Other eukaryotic N-acetylglucosaminyltransferase proteins that can be used in the present invention are include, e.g., BGnT-1, GnT-II, GnT-III, GnT-IV (e.g., GnT-IVa and GnT-IVb), GnT-V, GnT-VI, and GnT-IVH, which are exemplified at SEQ ID NOs: 140-160.

Other eukaryotic N-acetylglucosaminyltransferase proteins can be produced using the methods of the present invention and include, e.g., maniac fringe protein, MGNT1, and OGT proteins, exemplified at e.g., SEQ ID NOs:171-175.

A "eukaryotic N-acetylgalactosaminyltransferase (GalNAcT)" as used herein, refers to an N-acetylgalactosaminyltransferase isolated from a eukaryotic organism. The enzyme catalyzes the transfer of N-acetylgalactosamine (GalNAc) from a UDP-GalNAc donor to an acceptor molecule. Like other eukaryotic glycosyltransferases, GalNAcT enzymes have a transmembrane domain, a stem region, and a catalytic domain. A number of GalNAcT enzymes have been isolated and characterized, e.g., GalNAcT1, accession number X85018; GalNAcT2, accession number X85019 (both described in White et al., J. Biol. Chem. 270:24156-24165 (1995)); and GalNAcT3, accession number X92689 (described in Bennett et al., J. Biol. Chem. 271:17006-17012 (1996), each of which are herein incorporated by reference). Examples of eukaryotic N-acetylgalactosaminyltransferases follow and are also found in FIGS. 12-36 and in the attached sequence listing. Exemplary GalNAc-T2, GalNAc-T1, and GalNAc-T3 proteins are disclosed at, e.g., SEQ ID NOs:33-40 and 192-197, 126-132 and 189-191, and 133-135, respectively.

A "eukaryotic galactosyltransferase as used herein, refers to a galactosyltransferase derived from a eukaryotic organism. The enzyme catalyzes the transfer of galactose from a UDP-Gal donor to an acceptor molecule. Like other eukaryotic glycosyltransferases, galactosyltransferases have a transmembrane domain, a stem region, and a catalytic domain. Examples of eukaryotic galactosyltransferases follow and are also found in the attached sequence listing.

A "eukaryotic β-1,4-galactosyltransferase (GalT1) as used herein, refers to a β-1,4-galactosyltransferase derived from a eukaryotic organism. The enzyme catalyzes the transfer of galactose from a UDP-Gal donor to an acceptor molecule. Like other eukaryotic glycosyltransferases, GalT1 enzymes have a transmembrane domain, a stem region, and a catalytic domain. A number of GalT1 enzymes have been isolated and characterized, e.g., the full length bovine sequence, D'Agostaro et al., Eur. J. Biochem. 183:211-217 (1989) and accession number CAA32695, each of which are herein incorporated by reference. Exemplary GalT1 proteins are disclosed at, e.g., SEQ ID NOs:12-21. Other galactosyltransferases that can be used in the present invention include, e.g., SEQ ID NOs:136-139.

A "eukaryotic core I galactosyltransferase (Core 1 GalT1 or Core-1-Gal-T1)" as used herein refers to a protein with Core 1 β1,3-Galactosyltransferase activity. Like other eukaryotic glycosyltransferases, Core 1 GalT1 enzymes have a transmembrane domain, a stem region, and a catalytic domain. A number of Core 1 GalT1 enzymes have been isolated and characterized, e.g., the Drosophila and human sequences. The human protein is characterized in Ju et al., J. Biol. Chem. 277 (1), 178-186 (2002), which is herein incorporated by reference for all purposes. Exemplary Core 1 GalT1 proteins are disclosed at, e.g., SEQ ID NOs:41-52 and 198-199.

A "eukaryotic fucosyltransferase" as used herein, refers to a fucosyltransferase derived from a eukaryotic organism. The enzyme catalyzes the transfer of fucose from a UDP-fucose donor to an acceptor molecule. Like other eukaryotic glycosyltransferases, fucosyltransferases have a transmembrane domain, a stem region, and a catalytic domain. Examples of eukaryotic galactosyltransferases follow and are also found in the attached sequence listing. Exemplary eukaryotic fucosyltransferase proteins that can be used in the present invention are disclosed at, e.g., SEQ ID NOs:98-125. Also included in the methods of the invention are peptide-O-fucosyltransferase proteins, exemplified at, e.g., SEQ ID NOs:167-170.

Other eukaryotic glycosyltransferase proteins that can be used in the present invention include, e.g., dolichyl-phosphate mannosyltransferase polypeptide 1, or Dpm1, exemplified at SEQ ID NO:162; alpha-1,6-mannosyltransferase, alpha-1,3-mannosyltransferase, and beta-1,4-mannosyltransferase proteins, exemplified at SEQ ID NOs:163-166.

A "therapeutic protein" as used herein, refers a protein, peptide, glycoprotein or glycopeptide that is administered to a subject to treat disease or dysfunction or to improve health of the subject. In a preferred embodiment the subject is a human. In a further preferred embodiment, the therapeutic protein is a human protein. In an additional embodiment, the therapeutic protein is glycosylated or otherwise modified by one or more glycosyltransferases produced in a microorganism that has an oxidizing intracellular environment.

An "unpaired cysteine residue" as used herein, refers to a cysteine residue, which in a correctly folded protein (i.e., a protein with biological activity), does not form a disulfide bind with another cysteine residue.

A "redox couple" refers to mixtures of reduced and oxidized thiol reagents and include reduced and oxidized glutathione (GSH/GSSG), cysteine/cystine, cysteamine/cystamine, DTT/GSSG, and DTE/GSSG. (See, e.g., Clark, Cur. Op. Biotech. 12:202-207 (2001)).

The term "oxidant" or "oxidizing agent" refers to a compound which oxidizes molecules in its environment, i.e., which changes the molecules in its environment to become more oxidized and more oxidizing. An oxidant acts by accepting electrons, thereby becoming itself reduced after having oxidized a substrate. Thus, an oxidant is an agent which accepts electrons.

The term "oxidizing conditions" or "oxidizing environment" refers to a condition or an environment in which a substrate is more likely to become oxidized than reduced. For example, the periplasm of a wild type E. coli cell constitutes an oxidizing environment, whereas the cytoplasm of a wild type E. coli cell is a reducing environment.

An enzyme in an "oxidized state" refers to an enzyme that has fewer electrons than its reduced form.

The term "reductant" or "reducing agent" refers to a compound which reduces molecules in its environment, i.e., which changes molecules in its environment to become more reduced and more reducing. A reducing agent acts by donating electrons, thereby becoming itself oxidized after having reduced a substrate. Thus, a reducing agent is an agent which donates electrons. Examples of reducing agents include dithiothreitol (DTT), mercaptoethanol, cysteine, thioglycolate, cysteamine, glutathione, and sodium borohydride.

The term "reductase" refers to a thioredoxin reductase, glutathione or glutathione reductase (also referred to as "oxidoreductases") or any other enzyme that can reduce members of the thioredoxin or glutaredoxin systems.

The term "reductase pathways" refers to the systems in cells which maintain the environment in reducing conditions, and includes the glutaredoxin system and the thioredoxin system.

The term "reducing conditions" or "reducing environment" refers to a condition or an environment in which a substrate is more likely to become reduced than oxidized. For example, the cytoplasm of a eukaryotic cell constitutes a reducing environment.

"Disulfide bond formation" or "disulfide bond oxidation", used interchangeably herein, refers to the process of forming a covalent bond between two cysteines present in one or two polypeptides. Oxidation of disulfide bonds is mediated by thiol-disulfide exchange between the active site cysteines of enzymes and cysteines in the target protein. Disulfide bond formation is catalyzed by enzymes which are referred to as catalysts of disulfide bond formation.

An enzyme in a "reduced state", has more electrons than its oxidized form.

"Disulfide bond reduction" refers to the process of cleaving a disulfide bond, thereby resulting in two thiol groups. Reduction of disulfide bonds is mediated by thiol-disulfide exchange between the active site cysteines of enzymes and cysteines in the target protein.

The term "disulfide bond isomerization" refers to an exchange of disulfide bonds between different cysteines, i.e., the shuffling of disulfide bonds. Isomerization of disulfide bonds is mediated by thiol-disulfide exchange between the active site cysteines of enzymes and cysteines in the target protein and catalyzed by isomerases. In E. coli, isomerization is catalyzed by DsbC or DsbG a periplasmic disulfide bond oxidoreductase.

A "catalyst of disulfide bond formation" is an agent which stimulates disulfide bond formation. Such an agent must be in an oxidized state to be active.

A "catalyst of disulfide bond isomerization", also referred to as an "disulfide bond isomerase" is an agent which stimulates disulfide bond isomerization. Such an agent must be in a reduced form to be active.

The term "contacting" is used herein interchangeably with the following: combined with, added to, mixed with, passed over, incubated with, flowed over, etc.

"Chaperone proteins" are proteins that are known to promote proper folding of newly synthesized proteins. Chaperone proteins include, e.g., trigger factor; members of the Hsp70 chaperone family, e.g. DnaK; members of the Hsp100 chaperone family, e.g. ClpB, and members of the Hsp60 chaperone family, e.g. GroEL. See, e.g., Sorensen and Mortensen, BioMed Central, microbialcellfactories.com/content/4/1/1. Chaperones are also known that allow protein folding at 4° C., e.g., Cpn60 and Cpn 10 from Oleispira antartica RB⁸T. See, e.g., Id. and Ferrer et al., *Nat. Biotechnol.* 21:1266-1267 (2003).

"Protein disulfide isomerases" or "PDI proteins" can make or shuffle disulfide bonds. PDI proteins are described e.g., in Georgiou et al. U.S. Pat. No. 6,027,888, which is herein incorporated by reference for all purposes. PDI proteins are derived from eukaryotic and prokaryotic organisms. Eukaryotic PDI proteins include those of the Interpro family IPR005792 Protein disulphide isomerase. Exemplary eukaryotic PDI proteins include PDI proteins from e.g., rat liver PDI, Ero1p and Pdi1p proteins from Sacchromyces. Prokaryotic proteins include e.g., DsbC from *E. coli*. See, e.g., Frand et al., *Trends in Cell Biol.* 10:203-210 (2000).

Other prokaryotic proteins that act to maintain the redox state of protein disulfide bonds include, e.g., DsbB, DsbA, DsbC, DsbD, and DsbG from *E. coli*. These proteins are well known n the art and are described in, e.g., Beckwith et al. U.S. Pat. No. 6,872,563, which is herein incorporated by reference for all purposes.

The term "PEG" refers to poly(ethylene glycol). PEG is an exemplary polymer that has been conjugated to peptides. The use of PEG to derivatize peptide therapeutics has been demonstrated to reduce the immunogenicity of the peptides and prolong the clearance time from the circulation. For example, U.S. Pat. No. 4,179,337 (Davis et al.) concerns non-immunogenic peptides, such as enzymes and peptide hormones coupled to polyethylene glycol (PEG) or polypropylene glycol. Between 10 and 100 moles of polymer are used per mole peptide and at least 15% of the physiological activity is maintained.

The term "specific activity" as used herein refers to the catalytic activity of an enzyme, e.g., a recombinant glycosyltransferase of the present invention, and may be expressed in activity units. As used herein, one activity unit catalyzes the formation of 1 μmol of product per minute at a given temperature (e.g., at 37° C.) and pH value (e.g., at pH 7.5). Thus, 10 units of an enzyme is a catalytic amount of that enzyme where 10 μmol of substrate are converted to 10 μmol of product in one minute at a temperature of, e.g., 37° C. and a pH value of, e.g., 7.5.

"N-linked" oligosaccharides are those oligosaccharides that are linked to a peptide backbone through asparagine, by way of an asparagine-N-acetylglucosamine linkage. N-linked oligosaccharides are also called "N-glycans." Naturally occurring N-linked oligosaccharides have a common pentasaccharide core of $Man_3GlcNAc_2$. They differ in the presence of, and in the number of branches (also called antennae) of peripheral sugars such as N-acetylglucosamine, galactose, N-acetylgalactosamine, fucose and sialic acid. Optionally, this structure may also contain a core fucose molecule and/or a xylose molecule. Using the soluble eukaryotic glycosyltransferases produced by the methods of the invention, oligosaccharides can be produced that mimic natural N-linked structures or that are designed by the user. In one embodiment of the invention, soluble eukaryotic glycosyltransferases that generate N-linked oligosaccharides are expressed in one or more microorganisms that have an oxidizing, intracellular environment. Soluble eukaryotic glycosyltransferases that generate N-linked oligosaccharides include, e.g., GnT1, GalT1, and ST3Gal3 enzymes.

"O-linked" oligosaccharides are those oligosaccharides that are linked to a peptide backbone through threonine, serine, hydroxyproline, tyrosine, or other hydroxy-containing amino acids. Using the soluble eukaryotic glycosyltransferases produced by the methods of the invention, oligosaccharides can be produced that mimic natural O-linked structures or that are designed by the user. In one embodiment of the invention, soluble eukaryotic glycosyltransferases that generate O-linked oligosaccharides are expressed in one or more microorganisms that have an oxidizing, intracellular environment. Soluble eukaryotic glycosyltransferases that generate O-linked oligosaccharides include, e.g., GalNAc-T2, Cor-1-Gal-T1, ST6GalNAc-1, and ST3Gal-1 enzymes.

A "substantially uniform glycoform" or a "substantially uniform glycosylation pattern," when referring to a glycoprotein species, refers to the percentage of acceptor substrates that are glycosylated by the glycosyltransferase of interest (e.g., fucosyltransferase). It will be understood by one of skill in the art, that the starting material may contain glycosylated acceptor substrates. Thus, the calculated amount of glycosylation will include acceptor substrates that are glycosylated by the methods of the invention, as well as those acceptor substrates already glycosylated in the starting material.

The term "biological activity" refers to an enzymatic activity of a protein. For example, biological activity of a sialyltransferase refers to the activity of transferring a sialic acid moiety from a donor molecule to an acceptor molecule. Biological activity of a GalNAcT2 refers to the activity of transferring an N-acetylgalactosamine moiety from a donor molecule to an acceptor molecule. For GalNAcT2 proteins, an acceptor molecule can be a protein, a peptide, a glycoprotein, or a glycopeptide. Biological activity of a GnT1 protein refers to the activity of transferring a N-acetylglucosamine moiety from a donor molecule to an acceptor molecule. Biological activity of a galactosyltransferase refers to the activity of transferring a galactose moiety from a donor molecule to an acceptor molecule.

"Commercial scale" refers to gram scale production of a glycosylated product in a single reaction. In preferred embodiments, commercial scale refers to production of at least about 0.2, 0.5, 1, 2, 5, 10, 15, 25, 50, 75, 80, 90 or 100, 125, 150, 175, 200, 500 or 1000 grams a glycosylated product in a single reaction. Commercial scale production of a eukaryotic glycosyltransferase polypeptide refers to gram scale production of a eukaryotic glycosyltransferase polypeptide. In preferred embodiments, commercial scale refers to production of between 1 U/kg protein to 1000 U/Kg protein.

The term "substantially" in the above definitions of "substantially uniform" generally means at least about 60%, at least about 70%, at least about 80%, or more preferably at least about 90%, and still more preferably at least about 95% of the acceptor substrates for a particular glycosyltransferase are glycosylated.

The term "amino acid" refers to naturally occurring and unnatural amino acids, e.g., synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an a carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid.

"Protein", "polypeptide", or "peptide" refer to a polymer in which the monomers are amino acids and are joined together through amide bonds, alternatively referred to as a polypeptide. When the amino acids are α-amino acids, either the L-optical isomer or the D-optical isomer can be used. Additionally, unnatural amino acids, for example, β-alanine, phenylglycine and homoarginine are also included. Amino acids that are not gene-encoded may also be used in the present invention. Furthermore, amino acids that have been modified to include reactive groups may also be used in the invention. All of the amino acids used in the present invention may be either the D- or L-isomer. The L-isomers are generally preferred. In addition, other peptidomimetics are also useful in the present invention. For a general review, see, Spatola, A. F., in CHEMISTRY AND BIOCHEMISTRY OF AMINO ACIDS, PEPTIDES AND PROTEINS, B. Weinstein, eds., Marcel Dekker, New York, p. 267 (1983).

The term "recombinant" when used with reference to a cell indicates that the cell replicates a heterologous nucleic acid, or expresses a peptide or protein encoded by a heterologous nucleic acid. Recombinant cells can contain genes that are not found within the native (non-recombinant) form of the cell. Recombinant cells can also contain genes found in the native form of the cell wherein the genes are modified and re-introduced into the cell by artificial means. The term also encompasses cells that contain a nucleic acid endogenous to the cell that has been modified without removing the nucleic acid from the cell; such modifications include those obtained by gene replacement, site-specific mutation, and related techniques. A "recombinant protein" is one which has been produced by a recombinant cell. In preferred embodiments, a recombinant eukaryotic glycosyltransferase is produced by a recombinant bacterial cell.

A "fusion protein" refers to a protein comprising amino acid sequences that are in addition to, in place of, less than, and/or different from the amino acid sequences encoding the original or native full-length protein or subsequences thereof. More than one additional domain can be added to a glycosyltransferase as described herein, e.g., an accessory domain and an epitope tag or purification tag, or multiple epitope tags or purification tags.

Components of fusion proteins include "accessory enzymes" and/or "purification tags." An "accessory enzyme" as referred to herein, is an enzyme that is involved in catalyzing a reaction that, for example, forms a substrate for a glycosyltransferase. An accessory enzyme can, for example, catalyze the formation of a nucleotide sugar that is used as a donor moiety by a glycosyltransferase. An accessory enzyme can also be one that is used in the generation of a nucleotide triphosphate required for formation of a nucleotide sugar, or in the generation of the sugar which is incorporated into the nucleotide sugar. Examples of accessory enzymes, and fusion of accessory enzymes are disclosed, e.g., in PCT application CA98/01180, filed on Dec. 15, 1998.

The recombinant glycosyltransferases of the invention can be constructed and expressed as a fusion protein with a molecular "purification tag" at one end, which facilitates purification of the protein. Such tags can also be used for immobilization of a protein of interest during the glycosylation reaction. Suitable tags include "epitope tags," which are a protein sequence that is specifically recognized by an antibody. Epitope tags are generally incorporated into fusion proteins to enable the use of a readily available antibody to unambiguously detect or isolate the fusion protein. A "FLAG tag" is a commonly used epitope tag, specifically recognized by a monoclonal anti-FLAG antibody, consisting of the sequence AspTyrLysAspAspAspAspLys (SEQ ID NO:201) or a substantially identical variant thereof. Other epitope tags that can be used in the invention include, e.g., myc tag, AU1, AU5, DDDDK (SEQ ID NO:202)(EC5), E tag, E2 tag, Glu-Glu, a 6 residue peptide, EYMPME (SEQ ID NO:203), derived from the Polyoma middle T protein, HA, HSV, IRS, KT3, S tage, S1 tag, T7 tag, V5 tag, VSV-G, β-galactosidase, Gal4, green fluorescent protein (GFP), luciferase, protein C, protein A, cellulose binding protein, GST (glutathione S-transferase), a step-tag, Nus-S, PPI-ases, Pfg 27, calmodulin binding protein, dsb A and fragments thereof, and granzyme B. Epitope peptides and antibodies that bind specifically to epitope sequences are commercially available from, e.g., Covance Research Products, Inc.; Bethyl Laboratories, Inc.; Abcam Ltd.; and Novus Biologicals, Inc.

Other suitable purification tags are known to those of skill in the art, and include, for example, an affinity tag such as a hexahistidine (SEQ ID NO:204) peptide or other poly-histidine peptides, which will bind to metal ions such as nickel or cobalt ions. Proteins comprising purification tags can be purified using a binding partner that binds the purification tag, e.g., antibodies to the purification tag, nickel or cobalt ions or resins, and amylose, maltose, or a cyclodextrin. Purification tags also include starch binding domains, E. coli thioredoxin domains (vectors and antibodies commercially available from e.g., Santa Cruz Biotechnology, Inc. and Alpha Diagnostic International, Inc.), and the carboxy-terminal half of the SUMO protein (vectors and antibodies commercially available from e.g., Life Sensors Inc.). Starch binding domains, such as a maltose binding domain from E. coli and SBD (starch binding domain) from an amylase of A. niger, are described in WO 99/15636, herein incorporated by reference. Affinity purification of a fusion protein comprising a starch binding domain using a betacyclodextrin (BCD)-derivatized resin is described in U.S. Ser. No. 60/468,374, filed May 5, 2003, herein incorporated by reference in its entirety.

Glycosyltransferases can also include a self-cleaving protein tag, such as an "intein". Inteins facilitate removal of, e.g., a purification or epitope tag. Inteins and kits for their use are commercially available, e.g., from New England Biolabs.

The term "functional domain" with reference to glycosyltransferases, refers to a domain of the glycosyltransferase that confers or modulates an activity of the enzyme, e.g., acceptor substrate specificity, catalytic activity, binding affinity, localization within the Golgi apparatus, anchoring to a cell membrane, or other biological or biochemical activity. Examples of functional domains of glycosyltransferases include, but are not limited to, the catalytic domain, stem region, signal-anchor or transmembrane domain, and amino-terminal cytoplasmic tail.

The terms "expression level" or "level of expression" with reference to a protein refers to the amount of a protein produced by a cell. The amount of protein produced by a cell can be measured by the assays and activity units described herein or known to one skilled in the art. One skilled in the art would know how to measure and describe the amount of protein produced by a cell using a variety of assays and units, respectively. Thus, the quantitation and quantitative description of the level of expression of a protein, e.g., a glycosyltransferase, is not limited to the assays used to measure the activity or the units used to describe the activity, respectively. The amount of protein produced by a cell can be determined by standard known assays, for example, the protein assay by Bradford (1976), the bicinchoninic acid protein assay kit from Pierce (Rockford, Ill.), or as described in U.S. Pat. No. 5,641,668. Another method of determining protein expression is to analyze a lysate or other sample containing the protein using gel electrophoresis, e.g., SDS-PAGE, followed by a visualization step. Visualization steps include protein dyes and stains, e.g., Comassie or silver stain, or immunoassays, such as western blot analysis using an antibody that will specifically bind to the protein of interest. Antibodies can be directed against the glycosyltransferase or against a purification or epitope tag covalently bound to the protein.

The term "enzymatic activity" refers to an activity of an enzyme and may be measured by the assays and units described herein or known to one skilled in the art. Examples of an activity of a glycosyltransferase include, but are not limited to, those associated with the functional domains of the enzyme, e.g., acceptor substrate specificity, catalytic activity, binding affinity, localization within the Golgi apparatus, anchoring to a cell membrane, or other biological or biochemical activity.

A "stem region" with reference to glycosyltransferases refers to a protein domain, or a subsequence thereof, which in the native glycosyltransferases is located adjacent to the signal anchor or transmembrane domain, between the membrane region and the shortest catalytic domain, and has been reported to function as a retention signal to maintain the glycosyltransferase in the Golgi apparatus and as a site of proteolytic cleavage. Stem regions generally start with the first hydrophilic amino acid following the hydrophobic transmembrane domain and end at the catalytic domain, or in some cases the first cysteine residue following the transmembrane domain. Exemplary stem regions include, but are not limited to, the stem region of fucosyltransferase VI, amino acid residues 40-54; the stem region of mammalian GnT1, amino acid residues from about 36 to about 103 (see, e.g., the human enzyme); the stem region of mammalian GalT1, amino acid residues from about 71 to about 129 (see e.g., the bovine enzyme); the stem region of mammalian ST3GalIII, amino acid residues from about 29 to about 84 (see, e.g., the rat enzyme); the stem region of invertebrate Core-1-Gal-T1, amino acid residues from about 36 to about 102 (see e.g., the *Drosophila* enzyme); the stem region of mammalian Core-1-Gal-T1, amino acid residues from about 32 to about 90 (see e.g., the human enzyme); the stem region of mammalian ST3Gal1, amino acid residues from about 28 to about 61 (see e.g., the porcine enzyme) or for the human enzyme amino acid residues from about 18 to about 58; the stem region of mammalian ST6GalNAc-1, amino acid residues from about 30 to about 207 (see e.g., the murine enzyme), amino acids 35-278 for the human enzyme or amino acids 37-253 for the chicken enzyme; the stem region of mammalian GalNAc-T2, amino acid residues from about 71 to about 129 (see e.g., the rat enzyme).

A "catalytic domain" refers to a protein domain, or a subsequence thereof, that catalyzes an enzymatic reaction performed by the enzyme. For example, a catalytic domain of a sialyltransferase will include a subsequence of the sialyltransferase sufficient to transfer a sialic acid residue from a donor to an acceptor saccharide. A catalytic domain can include an entire enzyme, a subsequence thereof, or can include additional amino acid sequences that are not attached to the enzyme, or a subsequence thereof, as found in nature. An exemplary catalytic region is, but is not limited to, the catalytic domain of fucosyltransferase VII, amino acid residues 39-342; the catalytic domain of mammalian GnT1, amino acid residues from about 104 to about 445 (see, e.g., the human enzyme); the catalytic domain of mammalian GalT1, amino acid residues from about 130 to about 402 (see e.g., the bovine enzyme); and the catalytic domain of mammalian ST3Gal3, amino acid residues from about 85 to about 374 (see, e.g., the rat enzyme). Catalytic domains and truncation mutants of GalNAc-T2 proteins are described in U.S. Ser. No. 60/576,530 filed Jun. 3, 2004; and US provisional patent application, filed Aug. 3, 2004; both of which are herein incorporated by reference for all purposes. Catalytic domains can also be identified by alignment with known glycosyltransferases.

A "subsequence" refers to a sequence of nucleic acids or amino acids that comprise a part of a longer sequence of nucleic acids or amino acids (e.g., protein) respectively.

A "glycosyltransferase truncation" or a "truncated glycosyltransferase" or grammatical variants, refer to a glycosyltransferase that has fewer amino acid residues than a naturally occurring glycosyltransferase, but that retains enzymatic activity. Truncated glycosyltransferases include, e.g., truncated GnT1 enzymes, truncated GalT1 enzymes, truncated ST3GalIII enzymes, truncated GalNAc-T2 enzymes, truncated Core 1 GalT1 enzymes, amino acid residues from about 32 to about 90 (see e.g., the human enzyme); truncated ST3Gal1 enzymes, truncated ST6GalNAc-1 enzymes, and truncated GalNAc-T2 enzymes. Any number of amino acid residues can be deleted so long as the enzyme retains activity. In some embodiments, domains or portions of domains can be deleted, e.g., a signal-anchor domain can be deleted leaving a truncation comprising a stem region and a catalytic domain; a signal-anchor domain and a portion of a stem region can be deleted leaving a truncation comprising the remaining stem region and a catalytic domain; or a signal-anchor domain and a stem region can be deleted leaving a truncation comprising a catalytic domain. Glycosyltransferase truncations can also occur at the C-terminus of the protein. For example, some GalNAcT enzymes have a C-terminal lectin domain that can be deleted without diminishing enzymatic activity.

The term "nucleic acid" refers to a deoxyribonucleotide or ribonucleotide polymer in either single-or double-stranded form, and unless otherwise limited, encompasses known analogues of natural nucleotides that hybridize to nucleic acids in a manner similar to naturally occurring nucleotides. Unless otherwise indicated, a particular nucleic acid sequence includes the complementary sequence thereof.

A "recombinant expression cassette" or simply an "expression cassette" is a nucleic acid construct, generated recombinantly or synthetically, with nucleic acid elements that are capable of affecting expression of a structural gene in hosts compatible with such sequences. Expression cassettes include at least promoters and optionally, transcription termination signals. Typically, the recombinant expression cassette includes a nucleic acid to be transcribed (e.g., a nucleic acid encoding a desired polypeptide), and a promoter. Additional factors necessary or helpful in effecting expression may also be used as described herein. For example, an expression cassette can also include nucleotide sequences that encode a signal sequence that directs secretion of an expressed protein from the host cell. Transcription termination signals, enhancers, and other nucleic acid sequences that influence gene expression, can also be included in an expression cassette. In preferred embodiments, a recombinant expression cassette encoding an amino acid sequence comprising a eukaryotic glycosyltransferase is expressed in a bacterial host cell.

A "heterologous sequence" or a "heterologous nucleic acid", as used herein, is one that originates from a source foreign to the particular host cell, or, if from the same source, is modified from its original form. Thus, a heterologous glycoprotein gene in a eukaryotic host cell includes a glycoprotein-encoding gene that is endogenous to the particular host cell that has been modified. Modification of the heterologous sequence may occur, e.g., by treating the DNA with a restriction enzyme to generate a DNA fragment that is capable of being operably linked to the promoter. Techniques such as site-directed mutagenesis are also useful for modifying a heterologous sequence.

The term "isolated" refers to material that is substantially or essentially free from components which interfere with the activity of an enzyme. For a saccharide, protein, or nucleic acid of the invention, the term "isolated" refers to material that is substantially or essentially free from components which normally accompany the material as found in its native state. Typically, an isolated saccharide, protein, or nucleic acid of the invention is at least about 80% pure, usually at least about 90%, and preferably at least about 95% pure as measured by band intensity on a silver stained gel or other method for determining purity. Purity or homogeneity can be indicated by a number of means well known in the art. For example, a protein or nucleic acid in a sample can be resolved by polyacrylamide gel electrophoresis, and then the protein or nucleic acid can be visualized by staining. For certain purposes high resolution of the protein or nucleic acid may be desirable and HPLC or a similar means for purification, for example, may be utilized.

The term "operably linked" refers to functional linkage between a nucleic acid expression control sequence (such as a promoter, signal sequence, or array of transcription factor binding sites) and a second nucleic acid sequence, wherein the expression control sequence affects transcription and/or translation of the nucleic acid corresponding to the second sequence.

The terms "identical" or percent "identity," in the context of two or more nucleic acids or protein sequences, refer to two or more sequences or subsequences that are the same or have a specified percentage of amino acid residues or nucleotides that are the same, when compared and aligned for maximum correspondence, as measured using one of the following sequence comparison algorithms or by visual inspection.

The phrase "substantially identical," in the context of two nucleic acids or proteins, refers to two or more sequences or subsequences that have at least greater than about 60% nucleic acid or amino acid sequence identity, 65%, 70%, 75%, 80%, 85%, 90%, preferably 91%, 92%, 93%, 94%, 95%, 96%, 97%, 98% or 99% nucleotide or amino acid residue identity, when compared and aligned for maximum correspondence, as measured using one of the following sequence comparison algorithms or by visual inspection. Preferably, the substantial identity exists over a region of the sequences that is at least about 50 residues in length, more preferably over a region of at least about 100 residues, and most preferably the sequences are substantially identical over at least about 150 residues. In a most preferred embodiment, the sequences are substantially identical over the entire length of the coding regions.

For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally, *Current Protocols in Molecular Biology*, F. M. Ausubel et al., eds., Current Protocols, a joint venture between Greene Publishing Associates, Inc. and John Wiley & Sons, Inc., (1995 Supplement) (Ausubel)).

Examples of algorithms that are suitable for determining percent sequence identity and sequence similarity are the BLAST and BLAST 2.0 algorithms, which are described in Altschul et al. (1990) *J. Mol. Biol.* 215: 403-410 and Altschuel et al. (1977) *Nucleic Acids Res.* 25: 3389-3402, respectively. Software for performing BLAST analyses is publiclyavailable through the National Center for Biotechnology Information ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89:10915(1989)).

In addition to calculating percent sequence identity, the BLAST algorithm also performs a statistical analysis of the similarity between two sequences (see, e.g., Karlin & Altschul, *Proc. Nat'l, Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

A further indication that two nucleic acid sequences or proteins are substantially identical is that the protein encoded by the first nucleic acid is immunologically cross reactive with the protein encoded by the second nucleic acid, as described below. Thus, a protein is typically substantially identical to a second protein, for example, where the two peptides differ only by conservative substitutions. Another indication that two nucleic acid sequences are substantially identical is that the two molecules hybridize to each other under stringent conditions, as described below.

The phrase "hybridizing specifically to" refers to the binding, duplexing, or hybridizing of a molecule only to a particular nucleotide sequence under stringent conditions when that sequence is present in a complex mixture (e.g., total cellular) DNA or RNA.

The term "stringent conditions" refers to conditions under which a probe will hybridize to its target subsequence, but to no other sequences. Stringent conditions are sequence-dependent and will be different in different circumstances. Longer sequences hybridize specifically at higher temperatures. Generally, stringent conditions are selected to be about 15° C. lower than the thermal melting point (Tm) for the specific sequence at a defined ionic strength and pH. The Tm is the temperature (under defined ionic strength, pH, and nucleic acid concentration) at which 50% of the probes complementary to the target sequence hybridize to the target sequence at equilibrium. (As the target sequences are generally present in excess, at Tm, 50% of the probes are occupied at equilibrium). Typically, stringent conditions will be those in which the salt concentration is less than about 1.0 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. For selective or specific hybridization, a positive signal is typically at least two times background, preferably 10 times background hybridization. Exemplary stringent hybridization conditions can be as following: 50% formamide, 5× SSC, and 1% SDS, incubating at 42° C., or, 5× SSC, 1% SDS, incubating at 65° C., with wash in 0.2× SSC, and 0.1% SDS at 65° C. For PCR, a temperature of about 36° C. is typical for low stringency amplification, although annealing temperatures may vary between about 32-48° C. depending on primer length. For high stringency PCR amplification, a temperature of about 62° C. is typical, although high stringency annealing temperatures can range from about 50° C. to about 65° C., depending on the primer length and specificity. Typical cycle conditions for both high and low stringency amplifications include a denaturation phase of 90-95° C. for 30-120 sec, an annealing phase lasting 30-120 sec, and an extension phase of about 72° C. for 1-2 min. Protocols and guidelines for low and high stringency amplification reactions are available, e.g., in Innis, et al. (1990) *PCR Protocols: A Guide to Methods and Applications* Academic Press, N.Y.

The phrases "specifically binds to a protein" or "specifically immunoreactive with", when referring to an antibody refers to a binding reaction which is determinative of the presence of the protein in the presence of a heterogeneous population of proteins and other biologics. Thus, under designated immunoassay conditions, the specified antibodies bind preferentially to a particular protein and do not bind in a significant amount to other proteins present in the sample. Specific binding to a protein under such conditions requires an antibody that is selected for its specificity for a particular protein. A variety of immunoassay formats may be used to select antibodies specifically immunoreactive with a particular protein. For example, solid-phase ELISA immunoassays are routinely used to select monoclonal antibodies specifically immunoreactive with a protein. See Harlow and Lane (1988) *Antibodies, A Laboratory Manual*, Cold Spring Harbor Publications, New York, for a description of immunoassay formats and conditions that can be used to determine specific immunoreactivity.

"Conservatively modified variations" of a particular polynucleotide sequence refers to those polynucleotides that encode identical or essentially identical amino acid sequences, or where the polynucleotide does not encode an amino acid sequence, to essentially identical sequences. Because of the degeneracy of the genetic code, a large number of functionally identical nucleic acids encode any given protein. For instance, the codons CGU, CGC, CGA, CGG, AGA, and AGG all encode the amino acid arginine. Thus, at every position where an arginine is specified by a codon, the codon can be altered to any of the corresponding codons described without altering the encoded protein. Such nucleic acid variations are "silent variations," which are one species of "conservatively modified variations." Every polynucleotide sequence described herein which encodes a protein also describes every possible silent variation, except where otherwise noted. One of skill will recognize that each codon in a nucleic acid (except AUG, which is ordinarily the only codon for methionine, and UGG which is ordinarily the only codon for tryptophan) can be modified to yield a functionally identical molecule by standard techniques. Accordingly, each "silent variation" of a nucleic acid which encodes a protein is implicit in each described sequence.

Furthermore, one of skill will recognize that individual substitutions, deletions or additions which alter, add or delete a single amino acid or a small percentage of amino acids (typically less than 5%, more typically less than 1%) in an encoded sequence are "conservatively modified variations" where the alterations result in the substitution of an amino acid with a chemically similar amino acid. Conservative substitution tables providing functionally similar amino acids are well known in the art.

One of skill will appreciate that many conservative variations of proteins, e.g., glycosyltransferases, and nucleic acid which encode proteins yield essentially identical products. For example, due to the degeneracy of the genetic code, "silent substitutions" (i.e., substitutions of a nucleic acid sequence which do not result in an alteration in an encoded protein) are an implied feature of every nucleic acid sequence which encodes an amino acid. As described herein, sequences are preferably optimized for expression in a particular host cell used to produce the chimeric glycosyltransferases (e.g., yeast, human, and the like). Similarly, "conservative amino acid substitutions," in one or a few amino acids in an amino acid sequence are substituted with different amino acids with highly similar properties (see, the definitions section, supra), are also readily identified as being highly similar to a particular amino acid sequence, or to a particular nucleic acid sequence which encodes an amino acid. Such conservatively substituted variations of any particular sequence are a feature of the present invention. See also, Creighton (1984) *Proteins*, W.H. Freeman and Company. In addition, individual substitutions, deletions or additions which alter, add or delete a single amino acid or a small percentage of amino acids in an encoded sequence are also "conservatively modified variations".

The practice of this invention can involve the construction of recombinant nucleic acids and the expression of genes in host cells, preferably bacterial host cells. Molecular cloning techniques to achieve these ends are known in the art. A wide variety of cloning and in vitro amplification methods suitable for the construction of recombinant nucleic acids such as expression vectors are well known to persons of skill. Examples of these techniques and instructions sufficient to direct persons of skill through many cloning exercises are found in Berger and Kimmel, *Guide to Molecular Cloning Techniques, Methods in Enzymology* volume 152 Academic Press, Inc., San Diego, Calif. (Berger); and *Current Protocols in Molecular Biology*, F. M. Ausubel et al., eds., Current Protocols, a joint venture between Greene Publishing Associates, Inc. and John Wiley & Sons, Inc., (1999 Supplement) (Ausubel). Suitable host cells for expression of the recombinant polypeptides are known to those of skill in the art, and include, for example, prokaryotic cells, such as *E. coli*, and eukaryotic cells including insect, mammalian and fungal cells (e.g., *Aspergillus niger*)

Examples of protocols sufficient to direct persons of skill through in vitro amplification methods, including the polymerase chain reaction (PCR) the ligase chain reaction (LCR), Qβ-replicase amplification and other RNA polymerase mediated techniques are found in Berger, Sambrook, and Ausubel, as well as Mullis et al. (1987) U.S. Pat. No. 4,683,202; *PCR Protocols A Guide to Methods and Applications* (Innis et al. eds) Academic Press Inc. San Diego, Calif. (1990) (Innis); Arnheim & Levinson (Oct. 1, 1990) *C&EN* 36-47; *The Journal Of NIH Research* (1991) 3: 81-94; (Kwoh et al. (1989) *Proc. Natl. Acad. Sci. USA* 86: 1173; Guatelli et al. (1990) *Proc. Natl. Acad. Sci. USA* 87: 1874; Lomell et al. (1989) *J. Clin. Chem.* 35: 1826; Landegren et al. (1988) *Science* 241: 1077-1080; Van Brunt (1990) *Biotechnology* 8: 291-294; Wu and Wallace (1989) *Gene* 4: 560; and Barringer et al. (1990) *Gene* 89: 117. Improved methods of cloning in vitro amplified nucleic acids are described in Wallace et al., U.S. Pat. No. 5,426,039.

DETAILED DESCRIPTION OF THE INVENTION

I. Introduction

This invention provides for the first time methods of enhancing production of soluble, active eukaryotic glycosyltransferases in microorganisms by using prokaryotic organisms, e.g., bacteria that have oxidizing intracellular environments. The invention encompasses improving glycosyltransferase expression through the use of prokaryotic organisms that naturally have oxidizing intracellular environments, such as *Pseudomonas*. The invention also encompasses use of prokaryotic organisms that have reducing intracellular environments naturally, but that are manipulated to have an oxidizing intracellular environment. For example, *E. coli* generally have a reducing intracellular environment. Expression of heterologous proteins in *E. coli* frequently can be difficult or impractical because disulfide bonds are not properly oxidized, leading to protein misfolding and expression of proteins in inclusion bodies. *E. coli* and other prokaryotic organisms that have a naturally reducing intracellular environment can be manipulated, however, to generate an intracellular environment that favors oxidation of disulfide bonds. For example, *E. coli* can be manipulated to reduce activity of endogenous reductase proteins either by mutation of the nucleic acids encoding those proteins or by manipulation of other protein activities in an intracellular oxidation-reduction cycle. For example, in *E. coli*, inactivating mutations in the thioredoxin reductase protein (trxB), the glutathione reductase protein (gor), or in both proteins result in cells that have an oxidizing environment. *E. coli* cells that have mutations in trxB and gor are commercially available, e.g., from EMD Biosciences, Inc.

In preferred embodiments, the soluble active eukaryotic glycosyltransferases are expressed intracellularly within the prokaryotic microorganism that has an oxidizing environment, i.e., within the cell membrane and not in the periplasmic space or secreted from the cell.

In another preferred embodiment, the soluble eukaryotic glycosyltransferases expressed in a prokaryotic microorganism that has an oxidizing environment maintain their enzymatic activity and are unglycosylated, differently glycosylated or minimally glycosylated as compared to the same eukaryotic glycosyltransferase when expressed in a eukaryotic cell, e.g., a yeast, a mammalian cell or a cell of origin, i.e. a human cell for a human glycosyltransferase.

In one embodiment, production of soluble, active eukaryotic glycosyltransferases in prokaryotic microorganisms that have oxidizing intracellular environments is further enhanced by growing the cells under conditions that reduce the level of recombinant protein production, i.e., the eukaryotic glycosyltransferase, below that of a maximal level.

In another preferred embodiment, production of soluble, active eukaryotic glycosyltransferases in prokaryotic organisms that have oxidizing intracellular environments by growing the cells under conditions that reduce the level of recombinant protein production, e.g., a lower than optimal growth temperature, results in both increased expression and increased activity of the soluble eukaryotic glycosyltransferase, as compared to its expression in a wild type host cell or cell with a reducing environment, e.g., *E. coli*.

II. Soluble Active Eukaryotic Glycosyltransferases and Their Expression in Prokaryotic Microorganisms with Oxidizing Intracellular Environments Any glycosyltransferase that is predominantly insoluble when expressed in a reducing environment, e.g., wild type *E. coli*, can be expressed in a prokaryotic organism that has an intracellular oxidizing environment to facilitate expression of an active, soluble protein. The glycosyltransferases are then used for synthesis or remodeling of oligosaccharides, glycoproteins, glycopeptides, or glycolipids. Preferred glycosyltransferases include eukaryotic glycosyltransferases, as described herein.

A. Eukaryotic Glycosyltransferases

Any eukaryotic glycosyltransferase can be used in the methods of the present invention. The eukaryotic glycosyltransferases can be the naturally occurring, unmodified proteins or can be glycosyltransferase that have been modified to enhance catalytic activity, or stability, or other characteristics of the proteins. Modification of eukaryotic glycosyltransferases include e.g., truncation of the protein to remove e.g., the stem region, the signal-anchor domain, or a portion of the stem region or the signal-anchor domain, or removal of both the stem region and the signal-anchor domain; or removal of an unpaired cysteine residue by substitution to another amino acid residue. A glycosyltransferase can also be truncated at the C-terminus to remove a non-catalytic domain or domains. For example, a C-terminal lectin domain can be removed from GalNAcT enzymes without diminishing enzymatic activity. Modified glycosyltransferases are described e.g., in U.S. Ser. No. 60/542,210, filed Feb. 4, 2004; U.S. Ser. No. 60/599,406, filed Aug. 6, 2004; U.S. Ser. No. 60/627,406, filed Nov. 12, 2004; U.S. Ser. No. 60/576,433, filed Jun. 3, 2004; U.S. Ser. No. 60/650,011, filed Feb. 4, 2005; PCT/US05/19583, filed Jun. 3, 2005; U.S. Ser. No. 60/576,530, filed Jun. 3, 2004; U.S. Ser. No. 60/598,584, filed Aug. 3, 2004; PCT/US05/19442, filed Jun. 3, 2005; PCT/US05/03856, filed Feb. 4, 2005; and WO 2004/063344; each of which is herein incorporated by reference for all purposes Preferred embodiments of the invention include methods of producing, e.g., a eukaryotic N-acetylglucosaminyltransferase (GnTI or GNTI, GnTII or GNTII, GnTIII or GNTIII, GnTIV or GNTIV, GnTV or GNTV, GnTIV or GNTIV); a eukaryotic N-acetylgalactosaminyltransferase (GalNAcT, e.g., GalNAcT1, GalNAcT2, or GalNAcT3); any galactosyltransferase, e.g., a eukaryotic β-1,4-galactosyltransferase (GalT1) or a eukaryotic core I galactosyltransferase (Core-1-Gal-T1); any eukaryotic sialyltransferase, e.g., a eukaryotic α(2,3)sialyltransferase (ST3Gal3), or a eukaryotic α-N- acetylgalactosaminide α-2,6-sialyltransferase I (ST6GalNAc-1), or a eukaryotic gal β1,3GalNAc α2,3-sialyltransferase (ST3Gal-1); and any eukaryotic fucosyltransferase. Many examples of proteins having the above listed activities are known, see, e.g., afmb.cnrs-mrs.fr/CAZY/, in particular Glycosyltransferase Families 2, 4, 6, 7, 10, 1, 12, 13, 14, 15, 16, 17, 18, 21, 22, 23, 24, 25, 26, 28, 29, 31, 32, 34, 37, 38, 41, 42, 49, 52, 54, 65, or 68. Other glycosyltransferases that can be produced using the disclosed methods are found in the attached informal sequence listing.

As indicated above, the glycosyltransferases can be modified before production using the disclosed methods. Modifications include, e.g., truncation of the glycosyltransferase to remove all or a portion of a non-catalytic domain, such as a cytoplasmic domain, a signal-anchor domain, a stem region, and or a lectin domain. Exemplary truncated glycosyltransferase that can be produced in the present invention include, e.g., ST3Gal III (Δ27, Δ28, Δ73, Δ85, Δ86), human GnT1 (Δ103), bovine GalT1 (Δ40, Δ129, Δ70), human GalNAcT2 (Δ51, Δ40, Δ73, Δ94, Δ51Δ445, Δ53, Δ53Δ445), ST3Gall (Δ45), Drosophila Core-1-Gal-T1 (Δ31, A50), and human ST6GalNAc1 mutants shown in Table 1.

TABLE 1

ST6GalNAcI Mutants

| Truncation Site | Mutation (first amino acid) |
|---|---|
| HUMAN | |
| Δ35 | K36 |
| Δ124 | K125 |
| Δ257 | S258 |
| Δ35 | K36 |
| Δ72 | T73 |
| Δ109 | E110 |
| Δ133 | M134 |
| Δ170 | T171 |
| Δ232 | A233 |
| Δ272 | G273 |
| CHICKEN | |
| Δ48 | Q49 |
| Δ152 | V153 |
| Δ225 | L226 |
| Δ226 | R227 |
| Δ232 | T233 |
| Δ231 | K232 |
| MOUSE | |
| Δ30 | K31 |
| Δ31 | D32 |
| Δ51 | E52 |
| Δ126 | S127 |
| Δ185 | S186 |
| Δ200 | S201 |

III. Intracellular, Oxidizing Environments

In preferred embodiments, soluble, active eukaryotic glycosyltransferases are expressed in prokaryotic organisms that have oxidizing cytoplasmic environments.

A. Identification of Intracellular, Oxidizing Environments

Protein refolding and protein activity frequently depend on the correct formation of disulfide bonds. Disulfide bonds are reversible thiol-disulfide (SH—SS) exchange reactions that are greatly influenced by the redox state of the environment surrounding the protein. In many cells, including E. coli and other prokaryotic organisms, glutathione, a tripeptide containing cysteine, is an important thiol-disulfide redox buffer. The redox state of prokaryotic microorganisms is also affected by other proteins, such as thioredoxins. Reductase proteins, in turn, regulate the redox state of glutathione, glutaredoxins and thioredoxins. In E. coli glutathiones, encoded by gshA and gshB, regulates the redox state of glutaredoxins. Reductase proteins include, e.g., thioredoxin reductase and glutathione oxidoreductase. E. coli has thioredoxins encoded by trxA and trxC genes, glutaredoxin 1, glutaredoxin 2, and glutaredoxin 3, encoded by grxA, grxB, and grxC genes. Many of the proteins that regulate the oxidation state of a cell, e.g., thioredoxin, glutathione, thioredoxin reductase and glutathione oxidoreductase, comprise an active site $CX_1X_2C$ motif. The proteins also comprise a protein structural motif known as the thioredxoin fold.

One method to identify prokaryotes that have an oxidizing intracellular environment is to measure the ratio of reduced glutathione (GSH) to oxidized glutathione (GSSG). Optimum ratios of GSH/GSSG for protein folding have been determined. In vitro, maximum yields of properly folded protein occur at GSH/GSSG ratios of less than 50, preferably less than 40, more preferably less than 30, still more preferably less than 20, and most preferably less than 10. In mammalian cells, cytoplasmic GSH/GSSG ratios ranged from 30/1 to 100/1, while secretory pathway (where most protein refolding occurs) GSH/GSSG ratios ranged from 1/1 to 3/1. Hwang et al., Science 257:1496-1502 (1992). E. coli express very few intracellular proteins with disulfide bonds. E. coli proteins that have disulfide bonds are secreted into the periplasmic space, which has an oxidizing environment. Typical wild type intracellular E. coli GSH/GSSG ratios ranged from 50/1 to 200/1. Hwang et al. supra.

The methods of the invention can by used to produce soluble eukaryotic glycosyltransferases in prokaryotic organisms that have an oxidizing intracellular environment. Microorganisms with an oxidizing intracellular environment typically have GSH/GSSG ratios of less than 50, preferably less than 40, more preferably less than 30, still more preferably less than 20, and most preferably less than 10. Thus, in some embodiments, the microorganisms of the invention will have GSH/GSSG ratios that range, e.g., from 0 to 50, or from 0.1 to 25, or from 0.5 to 10.

Prokaryotic organisms with intracellular environments can be identified by e.g., determining the intracellular GSH/GSSG ratio of the prokaryotic organisms. Assays for total glutathione concentration are commercially available from, e.g., Sigma. Assays for determination of a GSH/GSSG ratio are described, e.g., in Hwang et al., Science 257:1496-1502 (1992). Methods to quantify intracellular content of GSH and GSSG by derivitization with N-(1-pyrenyl)maleimide (NPM) followed by quantification using HPLC are described in Ostergaard, et al., J. Cell Biol. 166:337-345 (2004).

A number of additional assays are available to those of skill to determine whether a prokaryotic organism has an intracellular, oxidizing environment. Those assays include measurement of glutathione reductase activity and glutathione pool redox state (Tuggle and Fuchs, J. Bacter. 162:448-450 (1985)), sensitivity to thiol-specific oxidants in growth medium (Prinz et al., J. Biol. Chem. 272:15661-15667 (1997)), transcriptional activation of the OxyR gene in E. coli after exposure to hydrogen peroxide or diamide (Bessette et al., PNAS 96:13703-13708 (1999), measurement of the redox state of a reporter gene, such as a redox sensitive green fluorescent protein, (rxYFP) (Ostergaard et al., J. Cell Biol. 166: 337-345 (2004)), detection of glutathione using glutathione sensitive dyes such as monochlorobimane, CellTracker Green CMFDA, o-phthaldialdehyde, and naphthalene-2,3-dicaboxaldehyde from e.g., Molecular Probes, and oxidation of cysteine residue in proteins after exposure of cells to a sulfhydryl-alkylating reagent, such as 4-acetamido-4'-maleimidystibene-2,2-disulfonic acid (Jurado et al., J. Mol. Biol. 320:1-10 (2002)).

B. Prokaryotic Microorganisms that Have Oxidizing Intracellular Environments

The method of the invention are carried out using prokaryotic microorganisms that have oxidizing intracellular environments. Such microorganisms include prokaryotic microorganisms that have endogenous, intracellular oxidizing environments and prokaryotic microorganisms that are genetically manipulated to have an intracellular oxidizing environment.

Some prokaryotic organisms have endogenous, intracellular oxidizing environments and, thus, promote formation of protein disulfide bonds inside the cell. Oxidizing intracellular compartments in prokaryotic organisms specifically exclude a bacterial periplasmic space. Prokaryotic organisms that have endogenous, intracellular oxidizing environments can be used in to produce soluble, active eukaryotic glycosyltransferases in an intracellular compartment. Prokaryotic organisms with endogenous, intracellular oxidizing environments include members of e.g., *Pseudomonas* species, including *testosteroni, putida, aeruginosa, syringae*, and *fluorescens*; some gram positive bacteria; and some gram negative bacteria. Additional *Pseudomonas* species and strains are described in, e.g., U.S. Patent Application Publication No. US 2005/0186666, published Aug. 25, 2005, which is herein incorporated by reference for all purposes. Gram positive bacteria include, e.g., *Bacillus, Listeria, Staphylococcus, Streptococcus, Enterococcus*, and *Clostridium* species.

Prokaryotic organisms with modification of a redox pathway can also be used in the methods of the invention to produce soluble, active eukaryotic glycosyltransferases or soluble, active therapeutic proteins. Modifications can be performed on prokaryotic organisms that have a reducing environment, e.g., *E. coli* or other gram negative bacteria or some gram positive bacteria. The prokaryotic microorganisms are modified to promote an oxidizing intracellular environment, thereby enhancing intracellular disulfide bond formation and protein refolding of e.g., eukaryotic glycosyltransferases.

Many prokaryotic organisms use two pathways to reduce disulfide bonds that form in some cytoplasmic proteins, including recombinantly expressed proteins. The components of these pathways can be manipulated to promote formation of an intracellular oxidizing environment. The first pathway is the thioredoxin system, which generally includes a thioredoxin reductase and thioredoxin. Thioredoxin reductase maintains thioredoxin in a reduced state. The second pathway is the glutaredoxin system, which generally includes a glutathione oxidoreductase, glutathione, and glutaredoxins. Inactivating mutations of some components of these redox pathways can ultimately increase the formation of disulfide bonds in expressed proteins, and in the case of heterologous proteins expressed in the prokaryotic organism, can increase the solubility and activity of the expressed heterologous proteins. For example, in *E. coli* elimination of thioredoxin reductase activity results in an accumulation of oxidized thioredoxin that act as an oxidase in the intracellular compartment.

Some preferred examples are prokaryotic microorganisms that have reduced or absent reductase activity. For example, the activity of a thioredoxin reductase and/or a glutathione oxidoreductase can be reduced or eliminated to modify the intracellular environment, thereby producing an oxidizing intracellular environment that favors formation of disulfide bonds.

For example, *E. coli* strains that have mutations in both the thioredoxin reductase gene (trxB) and the glutathione oxidoreductase gene (gor) are able to express proteins with higher levels of disulfide bond formation. See, e.g., Prinz et al., *J. Biol. Chem.* 272:15661-15667 (1997). These trxB gor double mutants grow very slowly on most growth media, although growth can be enhanced by addition of a reductant, such as DTT. However, the double mutant strains frequently give rise to suppressor mutant strains that retain the trxB gor mutations and that grow faster in medium lacking DTT. One example of a trxB gor suppressor mutation in *E. coli* is a mutation of the gene ahpC, which encodes a catalytic subunit of the alkyl hydroperoxidase, AhpCF. This suppressor mutation adds a triplet to the DNA that encodes the catalytic site of the AhpCF enzyme. Fast growing double mutant *E. coli* strains, e.g., trxB, gor, supp and trxB, gshA, supp strains are disclosed in e.g., U.S. Pat. No. 6,872,563, which is herein incorporated by reference for all purposes. Such manipulated *E. coli* strains, e.g., trxB, gor, supp strains, are commercially available, e.g., under the trade names ORIGAMI™, ORIGAMI 2™, and ROSETTA-GAMI™, from e.g., EMD Biosciences, Inc. Other *E. coli* mutations can result in an oxidizing intracellular environment, e.g., trxB, gshA and trxB, gshA supp strains.

Other manipulations of components of a redox pathway in a microorganism can be used to enhance formation of disulfide bonds in a protein, e.g., a eukaryotic glycosyltransferase. For example, proteins with oxidizing activity, e.g., *E. coli* thioredoxin proteins in trxB, gor mutant strains, can be overexpressed in the prokaryotic microorganism. Another example is expression or overexpression of thioredoxin mutants that have enhanced oxidizing activity. Examples of such mutants are described in, e.g., Bessette, et al. *PNAS* 96:13703-13708 (1999). Targeted cytoplasmic expression of certain oxidizing enzymes can also be used to enhznce formation of intracellular disulfide bonds. For example oxidizing proteins that are typically expressed in the periplasmic space, e.g., DsbC, can be expressed in a bacterial cytoplasm by e.g., deleting a periplasmic targeting sequence or including a cytoplasmic retention sequence. Other oxidizing periplasmic proteins can be expressed in the bacterial cytoplasm to enhance oxidation of cytoplasmic proteins, e.g., by deleting a periplasmic targeting sequence or including a cytoplasmic retention sequence.

Thioredoxin reductase nucleic acids, glutathione oxidoreductase nucleic acids, thioredoxin nucleic acids, glutathione nucleic acids, and nucleic acids encoding other proteins involved in maintenance of an intracellular redox environment can be identified in other bacteria, e.g., *Azotobacter* sp. (e.g., *A. vinelandii*), *Pseudomonas* sp., *Rhizobium* sp., *Erwinia* sp., *Escherichia* sp. (e.g., *E. coli*), *Bacillus, Pseudomonas, Proteus, Salmonella, Serratia, Shigella, Rhizobia, Vitreoscilla, Paracoccus* and *Klebsiella* sp., among many others. Such genes can be identified by sequence analysis and comparison to known thioredoxin reductase genes, glutathione oxidoreductase genes, and genes encoding other proteins involved in maintenance of an intracellular redox environment or to the amino acid sequence of the encoded products. The encoded proteins can be further identified functionally by enzymatic assays or by genetic complementation assays of *E. coli* mutants of an appropriate gene function. The endogenous thioredoxin reductase and glutathione oxidoreductase genes can be e.g., mutated to inactivate the gene product using standard molecular biology techniques and those mutated strains can also be used to express proteins with increased levels of disulfide bond formation, as compared to unmutated strains.

IV. Expression of Soluble, Active Eukaryotic Glycosyltransferases in Prokaryotic Microorganisms That Have Oxidizing Environments Soluble, active eukaryotic glycosyltransferase polypeptides of the invention can be expressed in a variety of prokaryotic microorganisms with oxidizing intracellular environments, including *E. coli*, and other bacterial hosts, as described above.

Once expressed in a prokaryotic organism that has an oxidizing intracellular environment, the soluble, active eukaryotic glycosyltransferase polypeptides can be used to produce glycosylated products. For example, the soluble, active eukaryotic glycosyltransferase polypeptides can be isolated using standard protein purification techniques and used in in vitro reactions described herein to make glycosylated products. Partially purified soluble, active eukaryotic glycosyltransferase polypeptides can also be used in in vitro reactions to make glycosylated products, as can permeabilized prokaryotic organisms that express the soluble, active eukaryotic glycosyltransferase polypeptides.

Typically, the polynucleotide that encodes the eukaryotic glycosyltransferase polypeptide is placed under the control of a promoter that is functional in the desired prokaryotic organisms that has an oxidizing environment. An extremely wide variety of promoters are well known, and can be used in the expression vectors of the invention, depending on the particular application. Ordinarily, the promoter selected depends upon the cell in which the promoter is to be active. Other expression control sequences such as ribosome binding sites, transcription termination sites and the like are also optionally included. Constructs that include one or more of these control sequences are termed "expression cassettes." Accordingly, the invention provides expression cassettes into which the nucleic acids that encode fusion proteins are incorporated for high level expression in a desired microorganism that has an oxidizing environment.

Expression control sequences that are suitable for use in a particular host cell are often obtained by cloning a gene that is expressed in that cell. Commonly used prokaryotic control sequences, which are defined herein to include promoters for transcription initiation, optionally with an operator, along with ribosome binding site sequences, include such commonly used promoters as the beta-lactamase (penicillinase) and lactose (lac) promoter systems (Change et al., *Nature* (1977) 198: 1056), the tryptophan (trp) promoter system (Goeddel et al., *Nucleic Acids Res.* (1980) 8: 4057), the tac promoter (DeBoer, et al., *Proc. Natl. Acad. Sci. U.S.A.* (1983) 80:21-25); and the lambda-derived $P_L$ promoter and N-gene ribosome binding site (Shimatake et al., *Nature* (1981) 292: 128). The particular promoter system is not critical to the invention, any available promoter that functions in prokaryotes can be used.

For expression of soluble, active eukaryotic glycosyltransferase polypeptides in prokaryotic cells other than *E. coli*, a promoter that functions in the particular prokaryotic species is required. Such promoters can be obtained from genes that have been cloned from the species, or heterologous promoters can be used. For example, the hybrid trp-lac promoter functions in *Bacillus* in addition to *E. coli*. Promoters are known for other bacterial species, e.g. *Pseudomonas*. See, e.g., U.S. Patent Application Publication No. US 2005/0186666, published Aug. 25, 2005, which is herein incorporated by reference for all purposes.

A ribosome binding site (RBS) is conveniently included in the expression cassettes of the invention. An RBS in *E. coli*, for example, consists of a nucleotide sequence 3-9 nucleotides in length located 3-11 nucleotides upstream of the initiation codon (Shine and Dalgarno, *Nature* (1975) 254: 34; Steitz, In *Biological regulation and development: Gene expression* (ed. R. F. Goldberger), vol. 1, p. 349, 1979, Plenum Publishing, NY).

Either constitutive or regulated promoters can be used in the present invention. Regulated promoters can be advantageous because the host cells can be grown to high densities before expression of the fusion proteins is induced. High level expression of heterologous proteins slows cell growth in some situations and may not be desired in all situations, see below. An inducible promoter is a promoter that directs expression of a gene where the level of expression is alterable by environmental or developmental factors such as, for example, temperature, pH, anaerobic or aerobic conditions, light, transcription factors and chemicals. Such promoters are referred to herein as "inducible" promoters, which allow one to control the timing of expression of the glycosyltransferase or enzyme involved in nucleotide sugar synthesis. For *E. coli* and other bacterial host cells, inducible promoters are known to those of skill in the art. These include, for example, the lac promoter, the bacteriophage lambda $P_L$ promoter, the hybrid trp-lac promoter (Amann et al. (1983) *Gene* 25: 167; de Boer et al. (1983) *Proc. Nat'l. Acad. Sci. USA* 80: 21), and the bacteriophage T7 promoter (Studier et al. (1986) *J. Mol. Biol.*; Tabor et al. (1985) *Proc. Nat'l. Acad. Sci. USA* 82: 1074-8). These promoters and their use are discussed in Sambrook et al., supra. A particularly preferred inducible promoter for expression in prokaryotes is a dual promoter that includes a tac promoter component linked to a promoter component obtained from a gene or genes that encode enzymes involved in galactose metabolism (e.g., a promoter from a UDPgalactose 4-epimerase gene (galE)). The dual tac-gal promoter, which is described in PCT Patent Application Publ. No. WO98/20111.

Another inducible promoter is the cspA promoter, which is highly induced at low temperatures in *E. coli*. See, e.g., Sorensen and Mortensen, *BioMed Central*, microbialcellfactories.com/content/4/1/1 and Mujacic et al. *Gene* 238:325-3332 (1999).

A construct that includes a polynucleotide of interest operably linked to gene expression control signals that, when placed in an appropriate host cell, drive expression of the polynucleotide is termed an "expression cassette." Expression cassettes that encode the fusion proteins of the invention are often placed in expression vectors for introduction into the host cell. The vectors typically include, in addition to an expression cassette, a nucleic acid sequence that enables the vector to replicate independently in one or more selected host cells. Generally, this sequence is one that enables the vector to replicate independently of the host chromosomal DNA, and includes origins of replication or autonomously replicating sequences. Such sequences are well known for a variety of bacteria. For instance, the origin of replication from the plasmid pBR322 is suitable for most Gram-negative bacteria. Alternatively, the vector can replicate by becoming integrated into the host cell genomic complement and being replicated as the cell undergoes DNA replication. A preferred expression vector for expression of the enzymes is in bacterial cells is pTGK, which includes a dual tac-gal promoter and is described in PCT Patent Application Publ. NO. WO98/20111. Anothr useful cloning vector is pCWin2-MBP or a version of pCWin2 with a modified 5' UTR. See, e.g., PCT/US05/00302, filed Jan. 6, 2005, which is herein incorporated by reference for all purposes.

The construction of polynucleotide constructs generally requires the use of vectors able to replicate in bacteria. A plethora of kits are commercially available for the purification of plasmids from bacteria (see, for example, EasyPrepJ, FlexiPrepJ, both from Pharmacia Biotech; StrataCleanJ, from Stratagene; and, QIAexpress Expression System, Qiagen). The isolated and purified plasmids can then be further manipulated to produce other plasmids, and used to transfect cells. Cloning in e.g., *E. coli, Streptomyces* or *Bacillus* is possible.

Selectable markers are often incorporated into the expression vectors used to express the polynucleotides of the invention. These genes can encode a gene product, such as a protein, necessary for the survival or growth of transformed host cells grown in a selective culture medium. Host cells not transformed with the vector containing the selection gene will not survive in the culture medium. Typical selection genes encode proteins that confer resistance to antibiotics or other toxins, such as ampicillin, neomycin, kanamycin, chloramphenicol, or tetracycline. Alternatively, selectable markers may encode proteins that complement auxotrophic deficiencies or supply critical nutrients not available from complex media, e.g., the gene encoding D-alanine racemase for Bacilli. Often, the vector will have one selectable marker that is functional in, e.g., *E. coli*, or other cells in which the vector is replicated prior to being introduced into the host cell. A number of selectable markers are known to those of skill in the art and are described for instance in Sambrook et al., supra. An auxotrophic expression system is known for *Pseudomonas* species. See, e.g., U.S. Patent Application Publication No. US 2005/0186666, published Aug. 25, 2005, which is herein incorporated by reference for all purposes.

Construction of suitable vectors containing one or more of the above listed components employs standard ligation techniques as described in the references cited above. Isolated plasmids or DNA fragments are cleaved, tailored, and re-ligated in the form desired to generate the plasmids required. To confirm correct sequences in plasmids constructed, the plasmids can be analyzed by standard techniques such as by restriction endonuclease digestion, and/or sequence analysis according to known methods. Molecular cloning techniques to achieve these ends are known in the art. A wide variety of cloning and in vitro amplification methods suitable for the construction of recombinant nucleic acids are well-known to persons of skill. Examples of these techniques and instructions sufficient to direct persons of skill through many cloning exercises are found in Berger and Kimmel, *Guide to Molecular Cloning Techniques, Methods in Enzymology*, Volume 152, Academic Press, Inc., San Diego, Calif. (Berger); and Current Protocols in Molecular Biology, F. M. Ausubel et al., eds., *Current Protocols*, a joint venture between Greene Publishing Associates, Inc. and John Wiley & Sons, Inc., (1998 Supplement) (Ausubel).

A variety of common vectors suitable for use as starting materials for constructing the expression vectors of the invention are well known in the art. For cloning in bacteria, common vectors include pBR322 derived vectors such as PBLUESCRIPT™, and λ-phage derived vectors.

The methods for introducing the expression vectors into a chosen prokaryotic microorganism are not particularly critical, and such methods are known to those of skill in the art. For example, the expression vectors can be introduced into prokaryotic cells, including *E. coli*, by calcium chloride transformation, and into eukaryotic cells by calcium phosphate treatment or electroporation. Other transformation methods are also suitable.

Translational coupling may be used to enhance expression. The strategy uses a short upstream open reading frame derived from a highly expressed gene native to the translational system, which is placed downstream of the promoter, and a ribosome binding site followed after a few amino acid codons by a termination codon. Just prior to the termination codon is a second ribosome binding site, and following the termination codon is a start codon for the initiation of translation. The system dissolves secondary structure in the RNA, allowing for the efficient initiation of translation. See Squires, et. al. (1988), *J. Biol. Chem.* 263: 16297-16302.

The soluble, active eukaryotic glycosyltransferase polypeptides are preferably expressed intracellularly. Intracellular expression often results in surprisingly high yields. If necessary, the amount of soluble, active protein may be increased by performing refolding procedures (see, e.g., Sambrook et al., supra.; Marston et al., *Bio/Technology* (1984) 2: 800; Schoner et al., *Bio/Technology* (1985) 3: 151). In another embodiment, the soluble, active eukaryotic glycosyltransferase proteins are fused to a subsequence of protein A, a maltose binding protein, a starch binding protein, or bovine serum albumin (BSA), for example, to facilitate purification, secretion, or stability.

The soluble, active eukaryotic glycosyltransferase polypeptides of the invention can also be further linked to other bacterial proteins. This approach often results in high yields, because normal prokaryotic control sequences direct transcription and translation. In *E. coli*, lacZ fusions are often used to express heterologous proteins. Other examples are discussed below. Suitable vectors are readily available, such as the pUR, pEX, and pMR100 series (see, e.g., Sambrook et al., supra.). For certain applications, it may be desirable to cleave the non-glycosyltransferase amino acids from the fusion protein after purification. This can be accomplished by any of several methods known in the art, including cleavage by cyanogen bromide, a protease, or by Factor $X_a$ (see, e.g., Sambrook et al., supra.; Itakura et al., *Science* (1977) 198: 1056; Goeddel et al., *Proc. Natl. Acad. Sci. USA* (1979) 76: 106; Nagai et al., *Nature* (1984) 309: 810; Sung et al., *Proc. Natl. Acad. Sci. USA* (1986) 83: 561). Cleavage sites can be engineered into the gene for the fusion protein at the desired point of cleavage.

More than one recombinant protein may be expressed in a single host cell by placing multiple transcriptional cassettes in a single expression vector, or by utilizing different selectable markers for each of the expression vectors which are employed in the cloning strategy. For example, multiple glycosyltransferases can be expressed in a single cell, e.g., glycosyltransferases that direct N-linked glycosylation or glycosyltransferases that direct O-linked glycosylation.

A suitable system for obtaining recombinant proteins from *E. coli* which maintains the integrity of their N-termini has been described by Miller et al. *Biotechnology* 7:698-704 (1989). In this system, the gene of interest is produced as a C-terminal fusion to the first 76 residues of the yeast ubiquitin gene containing a peptidase cleavage site. Cleavage at the junction of the two moieties results in production of a protein having an intact authentic N-terminal residue.

V. Purification of Soluble, Active Eukaryotic Glycosyltransferases

The soluble, active eukaryotic glycosyltransferase polypeptides of the present invention are preferably expressed as intracellular proteins and can be used in this form, in the methods of the present invention. For example, permeabilized cells or a crude cellular extract containing the expressed intracellular soluble, active eukaryotic glycosyltransferase polypeptide can used in the methods of the present invention.

Alternatively, the soluble, active eukaryotic glycosyltransferase polypeptide can be purified according to standard procedures of the art, including ammonium sulfate precipitation, affinity columns, column chromatography, gel electrophoresis and the like (see, generally, R. Scopes, *Protein Purification*, Springer-Verlag, N.Y. (1982), Deutscher, *Methods in Enzymology Vol.* 182: *Guide to Protein Purification*., Academic Press, Inc. N.Y. (1990)). Substantially pure compositions of at least about 70, 75, 80, 85, 90% homogeneity are preferred, and 92, 95, 98 to 99% or more homogeneity are most preferred. The purified proteins may also be used, e.g., as immunogens for antibody production.

To facilitate purification and expression of the soluble, active eukaryotic glycosyltransferase polypeptides of the invention, the nucleic acids that encode the proteins can also include a coding sequence for an epitope or "tag" for which an affinity binding reagent is available, i.e. a purification tag. Examples of suitable epitopes include the myc and V-5 reporter genes; expression vectors useful for recombinant production of fusion proteins having these epitopes are commercially available (e.g., Invitrogen (Carlsbad Calif.) vectors pcDNA3.1/Myc-His and pcDNA3.1/V5-His are suitable for expression in mammalian cells). Additional expression vectors suitable for attaching a tag to the glycosyltransferases of the invention, and corresponding detection systems are known to those of skill in the art, and several are commercially available (e.g., FLAG" (Kodak, Rochester N.Y.). Another example of a suitable tag is a polyhistidine sequence, which is capable of binding to metal chelate affinity ligands. Typically, six adjacent histidines (SEQ ID NO:204) are used, although one can use more or less than six. Suitable metal chelate affinity ligands that can serve as the binding moiety for a polyhistidine tag include nitrilo-tri-acetic acid (NTA) (Hochuli, E. (1990) "Purification of recombinant proteins with metal chelating adsorbents" In Genetic Engineering: Principles and Methods, J. K. Setlow, Ed., Plenum Press, NY; commercially available from Qiagen (Santa Clarita, Calif.)). Other purification or epitope tags include, e.g., AU1, AU5, DDDDK (SEQ ID NO:202) (EC5), E tag, E2 tag, Glu-Glu, a 6 residue peptide, EYMPME, (SEQ ID NO:203) derived from the Polyoma middle T protein, HA, HSV, IRS, KT3, S tage, S1 tag, T7 tag, V5 tag, VSV-G, β-galactosidase, Gal4, green fluorescent protein (GFP), luciferase, protein C, protein A, cellulose binding protein, GST (glutathione S-transferase), a step-tag, Nus-S, PPI-ases, Pfg 27, calmodulin binding protein, dsb A and fragments thereof, and granzyme B. Epitope peptides and antibodies that bind specifically to epitope sequences are commercially available from, e.g., Covance Research Products, Inc.; Bethyl Laboratories, Inc.; Abcam Ltd.; and Novus Biologicals, Inc.

Purification tags also include maltose binding domains and starch binding domains. Proteins comprising purification tags can be purified using a binding partner that binds the purification tag, e.g., antibodies to the purification tag, nickel or cobalt ions or resins, and amylose, maltose, or a cyclodextrin. Purification tags also include starch binding domains, *E. Coli* thioredoxin domains (vectors and antibodies commercially available from e.g., Santa Cruz Biotechnology, Inc. and Alpha Diagnostic International, Inc.), and the carboxy-terminal half of the SUMO protein (vectors and antibodies commercially available from e.g., Life Sensors Inc.). Starch binding domains, such as a maltose binding domain from *E. coli* and SBD (starch binding domain) from an amylase of *A. niger*, are described in WO 99/15636, herein incorporated by reference. Affinity purification of a fusion protein comprising a starch binding domain using a betacyclodextrin (BCD)-derivatized resin is described in WO 2005/014779, published Feb. 17, 2005, herein incorporated by reference in its entirety. In some embodiments, a soluble, active eukaryotic glycosyltransferase polypeptide comprises more than one purification or epitope tag.

Other haptens that are suitable for use as tags are known to those of skill in the art and are described, for example, in the Handbook of Fluorescent Probes and Research Chemicals (6th Ed., Molecular Probes, Inc., Eugene Oreg.). For example, dinitrophenol (DNP), digoxigenin, barbiturates (see, e.g., U.S. Pat. No. 5,414,085), and several types of fluorophores are useful as haptens, as are derivatives of these compounds. Kits are commercially available for linking haptens and other moieties to proteins and other molecules. For example, where the hapten includes a thiol, a heterobifunctional linker such as SMCC can be used to attach the tag to lysine residues present on the capture reagent.

One of skill would recognize that modifications can be made to the catalytic or functional domains of the soluble, active eukaryotic glycosyltransferase polypeptide without diminishing their biological function. Some modifications may be made to facilitate the cloning, expression, or incorporation of the catalytic domain into a fusion protein. Such modifications are well known to those of skill in the art and include, for example, the addition of codons at either terminus of the polynucleotide that encodes the catalytic domain to provide, for example, a methionine added at the amino terminus to provide an initiation site, or additional amino acids (e.g., poly His) placed on either terminus to create conveniently located restriction enzyme sites or termination codons or purification sequences.

In preferred embodiments, purification of the eukaryotic glycosyltransferases is simplified by expression of the proteins in microorganisms that have oxidizing environments. Because the solubility of the expressed proteins is enhanced, time consuming purification steps, such as solubilization, denaturation, and refolding, can be omitted from a purification protocol.

The eukaryotic glycosyltransferases produced by the methods of the invention can be used to produce glycosylated protein and glycosylated peptide products. The glycosylated protein and glycosylated peptide products can also be purified, if desired by the user, with any of the protein purification methods described herein.

VI. Enhancement and Characterization of Protein Solubilization

Reduction of disulfide bonds in heterologously expressed proteins, such as the eukaryotic glycosyltransferase polypeptides used in the methods of the invention, frequently results in protein misfolding and precipitation out of solution. In bacterial cells such as e.g., *E. coli*, misfolded proteins are expressed as insoluble inclusion bodies. Solubilization of a protein is generally indicated by the presence of the protein in an aqueous fraction after centrifugation at an appropriate speed for an appropriate period. In addition, expression of properly folded proteins results in increased levels of protein activity. Thus, assays of enzyme activity can also be used to determine whether proper protein folding has occurred.

Solubilization of a eukaryotic glycosyltransferase polypeptide expressed in a microorganism with an oxidizing environment can be compared to solubilization of a eukaryotic glycosyltransferase polypeptide expressed in a microorganism with a reducing environment, e.g., an *E. coli* strain with a reducing environment. In some embodiments, a eukaryotic glycosyltransferase polypeptide expressed in a microorganism with an oxidizing environment is expressed in a soluble fraction at levels that are up to 1.1, 1.2, 1.5, 2, 3, 5, 10, 15, 20, 50, 100, 500, 1000, or up to 10,000 times greater than soluble levels of the same eukaryotic glycosyltransferase polypeptide expressed in a microorganism with a reducing environment. In other embodiments, a eukaryotic glycosyltransferase polypeptide expressed in a microorganism with an oxidizing environment has activity levels, e.g., U/cell or U/mg protein, up to 1.1, 1.2, 1.5, 2, 3, 5, 10, 15, 20, 50, 100, 500, 1000, or up to 10,000 times greater than activity levels of the same eukaryotic glycosyltransferase polypeptide expressed in a microorganism with a reducing environment.

A. Characterization of Protein Solubility

In preferred embodiments, the eukaryotic glycosyltransferases are expressed as soluble proteins intracellularly within a prokaryotic microorganism. Solubility of eukaryotic glycosyltransferase polypeptides can be determined as disclosed above, by determining protein levels in an aqueous fraction after centrifugation at an appropriate speed for an appropriate period. Protein levels can be determined using methods known to those of skill in the art, e.g., immunoassays or direct comparison of proteins separated by, e.g., SDS-PAGE. Immunoassays can be performed using antibodies specific for the eukaryotic glycosyltransferase polypeptide of interest or using antibodies specific for an epitope or purification tag that is covalently linked to the eukaryotic glycosyltransferase polypeptide.

Solubility can also be determined by assaying enzymatic activity of the eukaryotic glycosyltransferase polypeptides in a soluble fraction from a prokaryotic microorganism. In a preferred embodiment, glycosyltransferase activity is measurable in a soluble intracellular fraction from a prokaryotic microorganism.

The eukaryotic glycosyltransferase polypeptides can be used to make glycosylated products in in vitro reaction mixes, including, e.g., oligosaccharides, glycolipids, glycoproteins, and glycopeptides. The in vitro reaction mixtures can include permeabilized microorganisms comprising the eukaryotic glycosyltransferase polypeptides, partially purified eukaryotic glycosyltransferase polypeptides, or purified eukaryotic glycosyltransferase polypeptides; as well as donor substrates, acceptor substrates, and appropriate reaction buffers. For in vitro reactions, the eukaryotic glycosyltransferase polypeptides, acceptor substrates, donor substrates and other reaction mixture ingredients are combined by admixture in an aqueous reaction medium. The medium generally has a pH value of about 4.0 to about 9.0. The selection of a medium is based on the ability of the medium to maintain pH value at the desired level. Thus, in some embodiments, the medium is buffered to a pH value of about 7.5. If a buffer is not used, the pH of the medium should be maintained at about 5 to 8.5, depending upon the particular glycosyltransferase used. For e.g., sialyltransferases, the range is preferably from about 5.5 to about 8.0.

Enzyme amounts or concentrations are expressed in activity units, which is a measure of the initial rate of catalysis. One activity unit catalyzes the formation of 1 pmol of product per minute at a given temperature (typically 37° C.) and pH value (typically 7.5). Thus, 10 units of an enzyme is a catalytic amount of that enzyme where 10 µmol of substrate are converted to 10 µmol of product in one minute at a temperature of 37° C. and a pH value of 7.5.

The reaction mixture may include divalent metal cations ($Mg^{2+}$, $Mn^{2+}$). The reaction medium may also comprise solubilizing detergents (e.g., Triton or SDS) and organic solvents such as methanol or ethanol, if necessary. The enzymes can be utilized free in solution or can be bound to a support such as a polymer. The reaction mixture is thus substantially homogeneous at the beginning, although some precipitate can form during the reaction.

The temperature at which the above process is carried out can range from just above freezing to the temperature at which the most sensitive enzyme denatures. That temperature range is preferably about 0° C. to about 45° C., and more preferably at about 20° C. to about 37° C.

The reaction mixture so formed is maintained for a period of time sufficient to obtain the desired high yield of desired oligosaccharide determinants present on oligosaccharide groups attached to the glycoprotein to be glycosylated. For commercial-scale preparations, the reaction will often be allowed to proceed for between about 0.5-240 hours, and more typically between about 1-36 hours.

B. Enhancement of Protein Solubility

Further enhancement of solubility of eukaryotic glycosyltransferase polypeptides can occur, e.g., by reducing the rate of protein expression or by expressing the protein in combination with, e.g. a chaperone protein.

Enhancing the rate of formation of appropriate disulfide bonds can lead to higher expression of active soluble glycosyltransferases. Another method to enhance expression of active soluble glycosyltransferases is to reduce the rate of expression thereby allowing the nascent polypeptide more time to achieve a stable, soluble conformation. The combination of the two methods, as described herein, is a preferred embodiment of the invention. Maximal expression of a heterologous protein generally occurs under optimal growth condition for the host cells. One method to slow the expression of proteins is to slow the growth rate of the cells. In a preferred embodiment, host cells are grown at a temperature below their optimal growth temperature. For example, the optimal growth temperature of *E. coli* is 37° C. Therefore, a temperature less that optimal growth temperature for *E. coli* is less than 37° C., e.g., between 4° C. and 36° C., between 8° C. and 33° C., between 12° C. and 30° C., or between 18° C. and 26° C., or at about 20° C., or at about 24° C.

The temperature used to slow protein production will depend on the optimal growth temperature of the host cells. As an example, *E. coli* and many other bacteria have an optimal growth temperature of 37° C. Thus, a temperature lower than an optimal growth temperature for *E. coli* or for other bacteria that grow optimally at 37° C. could be between 4-35° C., between 12-30° C., or between 15-20° C. In a preferred embodiment the temperature lower than an optimal growth temperature for *E. coli* or for other bacteria that grow optimally at 37° C. is between 18 and 23° C. For cells that grow optimally at 30° C., as do many yeasts, a temperature lower than an optimal growth temperature could be between 10 and 25° C., between 12 and 21° C., or between 15 and 20° C.

Another method to reduce the rate of expression of a heterologous protein is to vary the concentration of a molecule that regulates expression from an inducible promoter. For example, some lacY mutations allow protein expression to be controlled by varying the amount of IPTG, the inducer molecule, in the medium. In preferred embodiments the concentration of IPTG in the medium is less than optimal for, e.g., expression of a protein that does not form inclusion bodies when over expressed in a prokaryotic microorganism.

In some embodiments, a eukaryotic glycosyltransferase polypeptide is expressed in a microorganism that has an oxidizing environment and that further comprises a heterologous chaperone protein. Chaperone proteins include, e.g., trigger factor; members of the Hsp70 chaperone family, e.g. DnaK; members of the Hsp100 chaperone family, e.g. ClpB, and members of the Hsp60 chaperone family, e.g. GroEL. See, e.g., Sorensen and Mortensen, *BioMed Central*, microbial-cellfactories.com/content/4/1/1. Chaperones are also known that allow protein folding at 4° C., e.g., Cpn60 and Cpn 10 from *Oleispira antartica* RB8$^T$. See, e.g., Id. and Ferrer et al., *Nat. Biotechnol.* 21:1266-1267 (2003). Exemplary chaperonin proteins include, but are not limited to, those listed in the attached informal sequence listing.

In other embodiments, a eukaryotic glycosyltransferase polypeptide is expressed in a microorganism that has an oxidizing environment that further comprises a heterologous protein disulfide isomerase (PDI). PDI proteins can make or shuffle disulfide bonds. PDI proteins are described e.g., in Georgiou et al. U.S. Pat. No. 6,027,888, which is herein incorporated by reference for all purposes. PDI proteins include e.g., rat liver PDI, Ero1p and Pdi1p proteins from Sacchromyces. Prokaryotic proteins include e.g. DsbC from *E. coli*. See, e.g., Frand et al., *Trends in Cell Biol.* 10:203-210 (2000). In some embodiments, DsbC are expressed in a bacterial cytoplasm by e.g., deleting a periplasmic targeting sequence or including a cytoplasmic retention sequence.

Other prokaryotic proteins that act to maintain the redox state of protein disulfide bonds include, e.g., DsbB, DsbA, DsbC, DsbD, and DsbG from *E. coli*. These proteins are well known in the art and are described in, e.g., Beckwith et al. U.S. Pat. No. 6,872,563, which is herein incorporated by reference for all purposes. In some embodiments, DsbB, DsbA, DsbC, DsbD, and DsbG are expressed in the bacterial cytoplasm to enhance oxidation of cytoplasmic proteins, e.g., by deleting a periplasmic targeting sequence or including a cytoplasmic retention sequence.

In a further embodiment, a eukaryotic glycosyltransferase polypeptide is expressed in a prokaryotic microorganism that has an oxidizing environment and that also comprises a heterologous chaperone protein and/or a heterologous PDI protein and or a protein such as DsbB, DsbA, DsbC, DsbD, and DsbG from *E. coli*.

C. Expression of Active, Truncated Eukaryotic Glycosyltransferases in Prokaryotic Microorganisms that have Reducing Environments Unexpectedly, some of the truncated eukaryotic glycosyltransferases had activity in prokaryotic organisms with reducing intracellular environments. The activity in a reducing intracellular environment was typically much less than the activity of the same protein in a prokaryotic organism that has an oxidizing intracellular environment. In some embodiments the truncated eukaryotic glycosyltransferases are fused to, e.g., a maltose binding domain or a starch binding domain, or combinations thereof.

For example, Table 4 shows that a wild-type truncated GnT1 protein fused to MBP had 1.7 U/liter of activity. In contrast, the same protein had 45 U/liter of activity when expressed in an *E. coli* trxB, gor, supp mutant. Other glycosyltransferases tested appeared to have no activity in the reducing environment of the JM109 cells. Therefore, in one embodiment, the invention includes methods of producing a truncated soluble, active glycosyltransferase in a microorganism that has a reducing environment, e.g., *E. coli*. In preferred embodiments, the glycosyltransferase is GnT1.

VII. Uses of Soluble Eukaryotic Glycosyltransferases Produced by Prokaryotic Microorganisms With Oxidizing Environments The invention provides methods of producing soluble, eukaryotic glycosyltransferases in prokaryotic microorganisms, preferably on a commercial scale. The soluble eukaryotic glycosyltransferases are then used to enzymatically synthesize glycoproteins, glycolipids, and oligosaccharide moieties, and to glycoPEGylate glycoproteins or glycopeptides, including therapeutic proteins, also preferably on a commercial scale. The enzymatic reactions of the invention take place in a reaction medium comprising at least one soluble, eukaryotic glycosyltransferase, acceptor substrate, and donor substrate, and typically a soluble divalent metal cation. In some embodiments, accessory enzymes and substrates for the accessory enzyme catalytic moiety are also present, so that the accessory enzymes can synthesize the donor substrate for the glycosyltransferase. The soluble, eukaryotic glycosyltransferase proteins catalyze the addition of a saccharide to an acceptor substrate, e.g., a soluble active therapeutic protein.

A number of methods of using glycosyltransferases to synthesize glycoproteins and glycolipids having desired oligosaccharide moieties are known. Exemplary methods are described, for instance, WO 96/32491, Ito et al. (1993) *Pure Appl. Chem.* 65: 753, and U.S. Pat. Nos. 5,352,670, 5,374, 541, and 5,545,553.

The soluble, eukaryotic glycosyltransferase proteins prepared as described herein can be used in combination with additional glycosyltransferases. For example, one can use a combination of soluble, eukaryotic glycosyltransferase protein and a bacterial glycosyltransferase. Similarly, the soluble, eukaryotic glycosyltransferase proteins can be used with recombinant accessory enzymes, which may or may not be fused to the soluble, eukaryotic glycosyltransferase proteins.

The products produced by the above processes can be used with or without further purification. In some embodiments, oligosaccharides are produced. Standard, well known techniques, for example, thin or thick layer chromatography, ion exchange chromatography, or membrane filtration can be used for recovery of glycosylated saccharides. Also, for example, membrane filtration, utilizing a nanofiltration or reverse osmotic membrane as described in commonly assigned AU Patent No. 735695 may be used. As a further example, membrane filtration wherein the membranes have a molecular weight cutoff of about 1000 to about 10,000 can be used to remove proteins. As another example, nanofiltration or reverse osmosis can then be used to remove salts. Nanofilter membranes are a class of reverse osmosis membranes which pass monovalent salts but retain polyvalent salts and uncharged solutes larger than about 200 to about 1000 Daltons, depending upon the membrane used. Thus, for example, the oligosaccharides produced by the compositions and methods of the present invention can be retained in the membrane and contaminating salts will pass through.

Products that are e.g., glycosylated proteins or glycosylated peptides can also be used without further purification. Or if desired by the user glycosylated proteins or glycosylated peptides can be isolated or purified using standard protein purification methods.

VIII. Donor Substrate/Acceptor Substrates

Suitable donor substrates used by the soluble, active eukaryotic glycosyltransferases and methods of the invention include, but are not limited to, UDP-Glc, UDP-GlcNAc, UDP-Gal, UDP-GalNAc, GDP-Man, GDP-Fuc, UDP-GlcUA, UDP-GlcNH$_2$, UDP-GalNH$_2$, and CMP-sialic acid. Guo et al., *Applied Biochem. and Biotech.* 68: 1-20 (1997)

Suitable acceptor substrates used by the soluble, eukaryotic glycosyltransferase proteins and methods of the invention include, but are not limited to, polysaccharides, oligosaccharides, proteins, lipids, gangliosides and other biological structures (e.g., whole cells) that can be modified by the methods of the invention. Exemplary structures, which can be modified by the methods of the invention include any of a number glycolipids, glycoproteins and carbohydrate structures known to those skilled in the art.

Examples of suitable acceptor substrates used in soluble, eukaryotic glycosyltransferase protein-catalyzed reactions are described in Guo et al., *Applied Biochem. and Biotech.* 68: 1-20 (1997), but are not limited thereto.

In preferred embodiments, the acceptor substrate is a therapeutic protein. Preferred therapeutic proteins for modification by the glycosyltransferase produced using microorganisms that have an oxidative, intracellular environment are found in Table 2.

TABLE 2

Preferred therapeutic proteins

Hormones and Growth Factors

Granulocyte colony
stimulating factor (G-CSF)
Granulocyte-macrophage colony
stimulating factor (GM-CSF)
TPO
Erythropoietin (EPO)
EPO variants
Follicle Stimulating Hormone (FSH)
Human Growth Hormone (HGH)
Insulin
alpha-TNF
Leptin
Human chorionic gonadotropin
Fibroblast growth factor-20 (FGF-20)
Fibroblast growth factor-20 (FGF-21)
Enzymes and Inhibitors Tissue-type plasminogen activator (TPA)
TPA variants
Urokinase
Factor VII clotting factor
Factor VIII
Factor IX clotting factor
Factor X
Factor XIII
hrDNase
Glucocerebrosidase (Cerezyme ™)
Hirudin
α1 antitrypsin (α1 protease inhibitor)
Antithrombin III
Acid α-glucosidase (acid maltase)
α galactosidase A
α-L-iduronidase
Urokinase
Cytokines and Chimeric Cytokines Interleukin-1 (IL-1), 1B, 2, 3, 4
Interferon-alpha (IFN-alpha)
Interferon -alpha-2b
Interferon -beta
Interferon -gamma
Interferon -omega
Receptors and Chimeric Receptors CD4
Tumor Necrosis Factor receptor (TNF-R)
TNF-R:IgG Fc fusion
Alpha-CD20
PSGL-1
Complement
GlyCAM or its chimera
N-CAM or its chimera
Monoclonal Antibodies (Immunoglobulins)

MAb-anti-RSV
MAb-anti-IL-2 receptor
MAb-anti-CEA
MAb-Glycoprotein IIb/IIIa (Reopro ™)
MAb-anti-EGF
MAb-Her-2 (Herceptin ™)
MAb-CD20 (Rituxan ™)
MAb-alpha-CD3
TNF receptor-IgG Fc fusion (Enbrel ™)

TABLE 2-continued

Preferred therapeutic proteins

MAb-TNFα (Remicade ™)
MAb-CD4
MAb-PSGL-1
Mab-anti F protein of Respiratory
Syncytial Virus
Anti-thrombin-III
Cells Red blood cells
White blood cells (e.g., T cells, B cells, dendritic cells,
macrophages, NK cells, neutrophils, monocytes and the like)
Stem cells
Platelets
Others Hepatitis B surface antigen (HbsAg)
Chimeric diphtheria toxin-IL-2

Other preferred therapeutic proteins that can be produced in prokaryotic organisms that have oxidizing intracellular environments are disclosed in Application No. PCT/US02/32263, filed Oct. 9, 2002; Provisional Patent Application No. 60/448,381, filed Feb. 19, 2003; Provisional Patent Application No. 60/438,582, filed Jan. 6, 2003; Provisional Patent Application No. 60/407,527, filed Aug. 28, 2002; Provisional Patent Application No. 60/404,249, filed Aug. 16, 2002; Provisional Patent Application No. 60/396,594, filed Jul. 17, 2002; Provisional Patent Application No. 60/391,777, filed Jun. 25, 2002; Provisional Patent Application No. 60/387,292, filed Jun. 7, 2002; Provisional Patent Application No. 60/334,301, filed Nov. 28, 2001; Provisional Patent Application No. 60/334,233, filed Nov. 28, 2001; Provisional Patent Application No. 60/344,692, filed Oct. 19, 2001; and Provisional Patent Application No. 60/328,523, filed Oct. 10, 2001; and in the following US Patent Application Publications 20040142856, 20040137557, 20040132640, 20040126838, 20040115168, 20040082026, 20040077836, 20040063911, 20040043446. The preferred therapeutic proteins in the above references are also referred to as preferred peptides for remodeling.

In some embodiments the therapeutic proteins include an O-linked glycosylation site. The O-linked glycosylation site can be naturally occurring in a wildtype protein or peptide, or can be in a mutant protein or peptide, for example, a mutant protein or peptide in which a non-naturally ocurring O-linked glycosylation site is introduced, or a mutant protein or peptide comprising both naturally occuring and non-naturally occurring O-linked glycosylation sites. Exemplary proteins with O-linkded glycosylation sites include, e.g., granulocyte colony stimulating factor (G-CSF), e.g., 175 and 178 amino acid wild types (with or without N-terminal methionine residues), interferon (e.g., interferon alpha, e.g., interferon alpha 2b, or interferon alpha 2a), granulocyte macrophage colony stimulating factor (GM-CSF), human growth hormone, interleukin (e.g., interleukin 2), and fibroblast growth factor (FGF). Examples of wild-type and mutant proteins and peptides are found in, e.g., PCT/US2004/014254, filed May 7, 2004; U.S. Provisional Patent Application No. 60/469,114, filed May 9, 2003; U.S. Provisional Patent Application No. 60/494,751, filed Aug. 13, 2003; U.S. Provisional Patent Application No. 60/495,076, filed Aug. 14, 2003; U.S. Provisional Patent Application No. 60/535,290, filed Jan. 8, 2003; PCT/US05/000799, filed Jan. 10, 2005; U.S. Ser. No. 11/033,365 filed Jan. 10, 2005; U.S. Provisional Patent Application No. 60/535,284, filed Jan. 8, 2004; U.S. Provisional Patent Application No. 60/544,411, filed Feb. 12, 2004; U.S.

Provisional Patent Application No. 60/546,631, filed Feb. 20, 2004; U.S. Provisional Patent Application No. 60/555,813, filed Mar. 23, 2004; U.S. Provisional Patent Application No. 60/570,891, filed May 12, 2004; PCT/US05/39226, filed Oct. 31, 2005; and U.S. Provisional Patent Application No. 60/623,342, filed Oct. 29, 2004; each of which is herein incorporated by reference for all purposes.

The invention also encompasses therapeutic proteins that have been modified to increase resistance to proteases. In one embodiment, the protease resistant therapeutic protein is a human growth hormone protein. Exemplary protease resistant therapeutic proteins are found in e.g., U.S. Provisional Patent Application No. 60/669,736, filed Apr. 8, 2005; U.S. Provisional Patent Application No. 60/710,401, filed Aug. 22, 2005; and U.S. Provisional Patent Application No. 60/720,030, filed Sep. 23, 2005; each of which is herein incorporated by reference for all purposes.

VII. Conjugation of Modified Sugars to Peptides

The modified sugars are conjugated to a glycosylated or non-glycosylated peptide or protein using an appropriate enzyme to mediate the conjugation. Preferably, the concentrations of the modified donor sugar(s), enzyme(s) and acceptor peptide(s) or protein(s) are selected such that glycosylation proceeds until the acceptor is consumed. The considerations discussed below, while set forth in the context of a sialyltransferase, are generally applicable to other glycosyltransferase reactions.

The present invention also provides for the industrial-scale production of modified peptides. As used herein, an industrial scale generally produces e.g., at least one microgram, one milligram, or one gram of finished, purified conjugate.

In the discussion that follows, the invention is exemplified by the conjugation of modified sialic acid moieties to a glycosylated peptide. The exemplary modified sialic acid is labeled with PEG. The focus of the following discussion on the use of PEG-modified sialic acid and glycosylated peptides is for clarity of illustration and is not intended to imply that the invention is limited to the conjugation of these two partners. One of skill understands that the discussion is generally applicable to the additions of modified glycosyl moieties other than sialic acid. Moreover, the discussion is equally applicable to the modification of a glycosyl unit with agents other than PEG including other water-soluble polymers, therapeutic moieties, and biomolecules.

An enzymatic approach can be used for the selective introduction of PEGylated or PPGylated carbohydrates onto a peptide or glycopeptide. The method utilizes modified sugars containing PEG, PPG, or a masked reactive functional group, and is combined with the appropriate glycosyltransferase. By selecting the glycosyltransferase that will make the desired carbohydrate linkage and utilizing the modified sugar as the donor substrate, the PEG or PPG can be introduced directly onto the peptide backbone, onto existing sugar residues of a glycopeptide or onto sugar residues that have been added to a peptide.

An acceptor for the sialyltransferase is present on the peptide to be modified by the methods of the present invention either as a naturally occurring structure or one placed there recombinantly, enzymatically or chemically. Suitable acceptors, include, for example, galactosyl acceptors such as Galβ1,4GlcNAc, Galβ1,4GalNAc, Galβ1,3GalNAc, lacto-N-tetraose, Galβ1,3GlcNAc, Galβ1,3Ara, Galβ1,6GlcNAc, Galβ1,4Glc (lactose),GalNAc and sialic acid containing structures, and other acceptors known to those of skill in the art (see, e.g., Paulson et al., *J. Biol. Chem.* 253: 5617-5624 (1978)).

In one embodiment, an acceptor for the sialyltransferase is present on the glycopeptide to be modified upon in vivo synthesis of the glycopeptide. Such glycopeptides can be sialylated using the claimed methods without prior modification of the glycosylation pattern of the glycopeptide. Alternatively, the methods of the invention can be used to sialylate a peptide that does not include a suitable acceptor; one first modifies the peptide to include an acceptor by methods known to those of skill in the art. In an exemplary embodiment, a GalNAc residue is added by the action of a GalNAc transferase.

In an exemplary embodiment, the galactosyl acceptor is assembled by attaching a galactose residue to an appropriate acceptor linked to the peptide, e.g., a GlcNAc. The method includes incubating the peptide to be modified with a reaction mixture that contains a suitable amount of a galactosyltransferase (e.g., galβ1,3 or galβ1,4), and a suitable galactosyl donor (e.g., UDP-galactose). The reaction is allowed to proceed substantially to completion or, alternatively, the reaction is terminated when a preselected amount of the galactose residue is added. Other methods of assembling a selected saccharide acceptor will be apparent to those of skill in the art.

In yet another embodiment, glycopeptide-linked oligosaccharides are first "trimmed," either in whole or in part, to expose either an acceptor for the sialyltransferase or a moiety to which one or more appropriate residues can be added to obtain a suitable acceptor. Enzymes such as glycosyltransferases and endoglycosidases (see, for example U.S. Pat. No. 5,716,812) are useful for the attaching and trimming reactions.

Methods for conjugation of modified sugars to peptides or proteins are found e.g., in U.S. Ser. No. 60/328,523 filed Oct. 10, 2001; U.S. Ser. No. 60/387,292, filed Jun. 7, 2002; U.S. Ser. No. 60/391,777 filed Jun. 25, 2002; U.S. Ser. No. 60/404,249 filed Aug. 16, 2002; and PCT/US02/32263; each of which are herein incorporated by reference for all purposes.

It must be noted that as used herein and in the appended claims, the singular forms "a", "and", and "the" include plural referents unless the context clearly dictates otherwise. Thus, for example, reference to "a cell" includes a plurality of such cells and equivalents thereof known to those skilled in the art, and so forth.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed. Citations are incorporated herein by reference.

EXAMPLES

Example 1

Expression of Glycosyltransferases from the O-linked Oligosaccharide Pathway

General Procedures

Constructs were designed to express maltose binding protein (MBP) fusions to amino-terminal truncations of the glycosyltransferases. Constructs are designated with a Δ(number) referring to the position of the last amino acid removed (for amino-terminal truncations) or the first amino acid removed (for carboxyl-terminal truncations) from the corresponding full-length protein. The following constructs were used: human MBP-GalNAc-T2 (Δ51), human GalNAc-T2

(Δ51 Δ445), *Drosophila* MBP-Core-1-Gal-T1 (Δ50), porcine MBP-ST3Gal-1 (Δ45), and porcine MBP—SBD-ST3Gal-1 (Δ45; SBD is the starch binding domain tag, inserted between the MBP and the catalytic domains), and human MBP-ST6GalNAc-1 (Δ35). Nucleic acids encoding the enzymes were typically cloned into the BamHI-XhoI or BamHI-EcoRI sites of pCWin2-MBP or a version of pCWin2 with a modified 5' UTR. See, e.g., PCT/US05/00302, filed Jan. 6, 2005, which is herein incorporated by reference for all purposes. Cloning was performed using standard techniques (e.g. Current Protocols in Molecular Biology, Ausubel, F M, et al, eds. John Wiley & Sons, Inc. 1998).

For protein expression, a loopful of cells from a fresh plate was used to inoculate a 100 mL culture of martone LB containing 50 µg/ml kanamycin. The cultures were incubated at 37° C. with shaking at 180-200 rpm, and monitored for $OD_{620}$. When the $OD_{620}$ reached 0.4-0.6, the cultures were transferred to a 20° C. shaking incubator (180-200 rpm) for 15-20 minutes. IPTG was then added to 0.1 mM final concentration, and shaking incubation at 20° C. was continued overnight. Cells were harvested by centrifugation at 4° C., 7000×g for 15 mins.

For the analysis of protein solubility and partial purification of fusion proteins, bacterial cell pellets from induced cultures were resuspended in 30 mL of TE (20 mM Tris pH 7.4, 1 mM EDTA), and lysed by mechanical disruption with two passes through a microfluidizer at 15,000 psi. Insoluble material was pelleted by centrifugation for 10 minutes at 3000-5000×g at 4° C. The supernatants were separated from the pellets, and a sample of each supernatant was taken for activity assay analysis. The remaining supernatants were adjusted to a final concentration of 200 mM NaCl, and incubated mixed at room temperature with washed amylose resin. After 1-2 hours, the beads were collected by brief centrifugation, washed with 10 bead bed volumes of Column Buffer (20 mM Tris pH 7.4, 200 mM NaCl, 1 mM EDTA), and collected in a disposable column. Purified fusion proteins were eluted with one bead bed volume of Column Buffer containing 10 mM maltose. Samples of the insoluble pellet, supernatant, and amylose resin elution were analyzed by SDS-PAGE.

For the assay of GalNAc-T2 activity, reactions were carried out in a mixture of enzyme sample with 20 mM Tris pH 7, 10 mM $MnCl_2$, 1.5 mM UDP-GalNAc, 1 mM synthetic peptide acceptor. Following a 30 minute incubation at 37° C., the reaction was quenched with 0.01N HCl, and the peptide acceptor was separated from the reaction mix by centrifugation through a 10,000 MWCO concentrator. Peptide and GalNAc-peptide were detected and quantified by RP-HPLC.

For the assay of Core-1-Gal-T1 activity, galactosyltransferase reactions were carried out in a mixture of enzyme sample with 3.5 mg/ml asialo-bovine submaxillary mucin (asialo-BSM), 50 mM MES pH 6.5, 20 mM $MnCl_2$, and radioactively-labeled UDP-galactose. Following a one hour incubation at 37° C., the reaction is stopped and the protein reaction products separated from the UDP-Gal by acid precipitation. Radioactive galactose transferred to the asialo-BSM was subsequently detected and quantified using a scintillation counter.

For the assay of ST6GalNAc-1 and ST3Gal-1, sialyltransferase assays were carried out in solid-phase format using asialo-BSM as an acceptor and biotinylated forms of the CMP-NAN donor. Briefly, a 96-well plate coated with asialo-BSM was incubated at 37° C. with samples of MBP-ST6GalNAc-1 and biotinylated CMP-NAN in 20 mM BisTris pH 6.7, 2.5 mM $MgCl_2$, 2.5 mM $MnCl_2$, 50 mM NaCl, 0.05% Tween-80 for 2-4 hours. The microplate was then washed, and biotinylated sialic acid transferred to the plate-bound asialo-BSM was labeled with europium-streptavidin, and detected by time resolved fluorescence.

ST3Gal-1

JM109 and trxB gor supp mutant cells bearing the MBP-ST3Gal-1 construct were induced for expression overnight at 20° C. As shown in FIG. 1, expression of MBP-ST3Gal-1 as a soluble protein was observed in both strains, with higher expression levels observed in the trxB gor supp mutant strain. The soluble fusion protein from both lysates was purified on amylose resin (FIG. 1), and activity assays on both lysate and partially purified protein samples indicated that the soluble fusion protein was enzymatically active (Table 3), with significantly higher levels of activity recovered from the trxB gor supp mutant cells.

GalNAc-T2

Figure 2B:
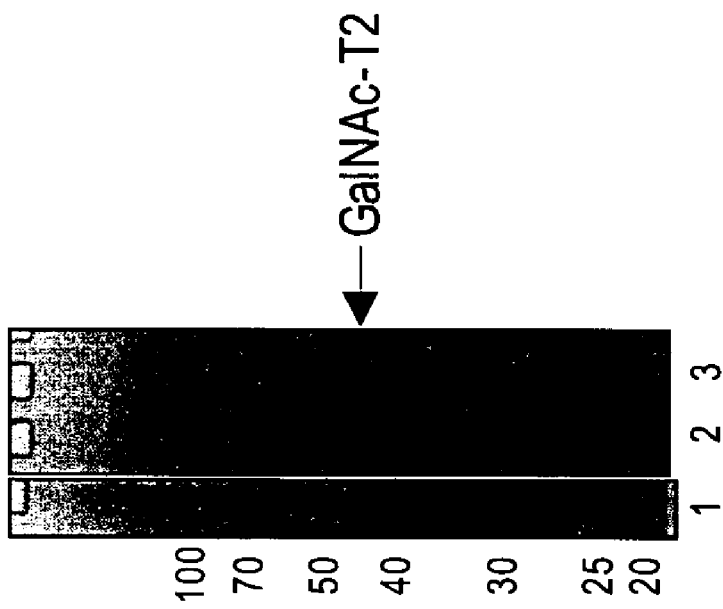
FIG. 2b demonstrates SDS-PAGE analysis of the expression and solubility of amino- and carboxyl-truncated human GalNAc-T2 expressed in trxB gor supp mutant E. coli. Lysed cells were separated by centrifugation into insoluble (lane 2) and soluble (lane 3) fractions and resolved by SDS-PAGE. The first lane is molecular weight markers.
Figure 2A:
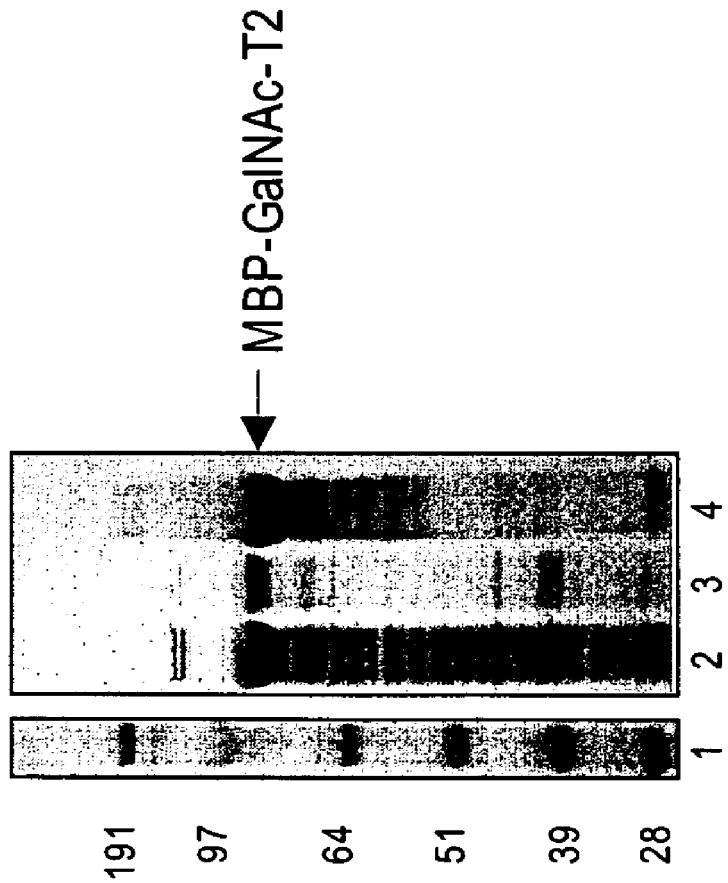
FIG. 2a demonstrates SDS-PAGE analysis of the expression and partial purification of soluble MBP-tagged truncated human GalNAc-T2 from trxB gor supp mutant lysates (lanes 2-4). Lanes 2-3 are clarified lysate before and after incubation with amylose resin, respectively. Lane 4 is the elution from the amylose resin containing partially purified MBP-GalNAc-T2. The first lane is molecular weight markers.

When expressed in JM109 cells, MBP-GalNAcT2 is predominantly insoluble, with only trace levels of activity detected in the soluble fraction (Table 3). The MBP-tagged truncated human GalNAc-T2 construct was introduced into a trxB gor supp mutant strain, and induced for expression overnight at 20° C. As shown in FIG. 2, MBP-GalNAc-T2 was solubly expressed and readily purified on amylose resin. Activity assays on both lysate and partially purified samples indicated that the soluble fusion protein was an active enzyme expressed at much higher levels than that observed in lysates from JM109 cells (Table 3). Truncated GalNAcT2 lacking both amino-terminal sequences and its carboxyl-terminal lectin domain was also soluble and active when expressed in trxB gor supp mutant cells (FIG. 2*b* and Table 3).

Core-1-Gal-T1

Figure 3:
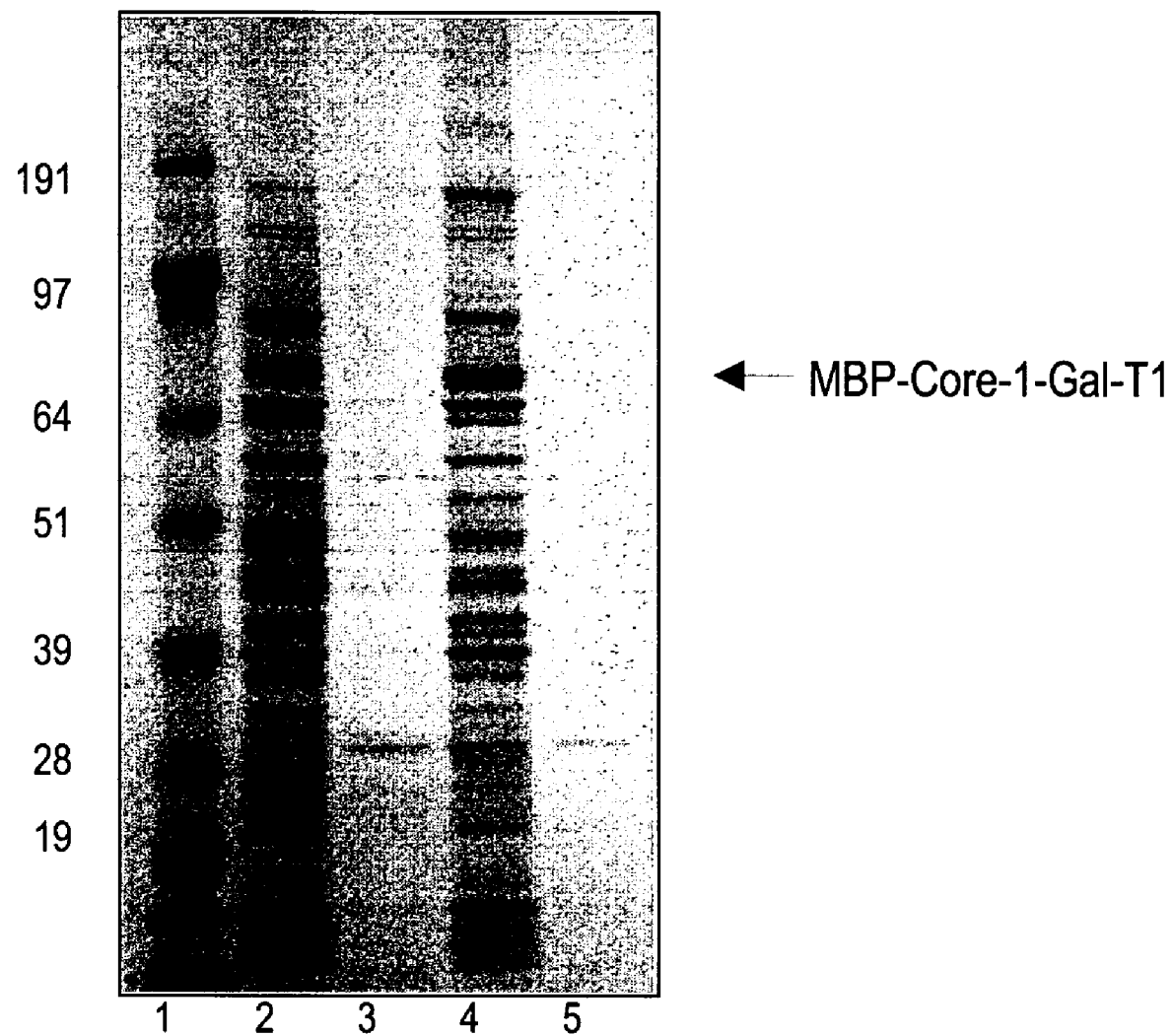
FIG. 3 demonstrates SDS-PAGE analysis of the expression and partial purification of soluble MBP-tagged truncated Drosophila Core-1-Gal-T1. MBP-Core-1-Gal-T1 was expressed and purified from JM109 (lanes 2-3) and trxB gor supp mutant (lanes 4-5) cells. Lane 1 contains molecular weight markers. Lanes 2 and 4 are clarified lysate, and partially purified amylose resin elutions are shown in lanes 3 and 5.

Previous work with MBP-tagged truncated *Drosophila* Core-1-Gal-T1 construct was expressed insolubly in JM109 cells with no apparent activity in the soluble fraction (Table 3). The MBP-tagged truncated *Drosophila* Core-1-Gal-T1 construct was introduced into a trxB gor supp mutant strain, and induced for expression overnight at 20° C. As shown in FIG. 3, MBP-GalNAc-T2 was preferably expressed as a soluble protein in the trxB gor supp mutant strain, and was partially purified on amylose resin. Activity assays on lysate samples indicated that the soluble protein was an active enzyme when expressed either MBP-tagged or untagged in the trxB gor supp mutant (Table 3).

ST6GalNAc-1

Figure 4:
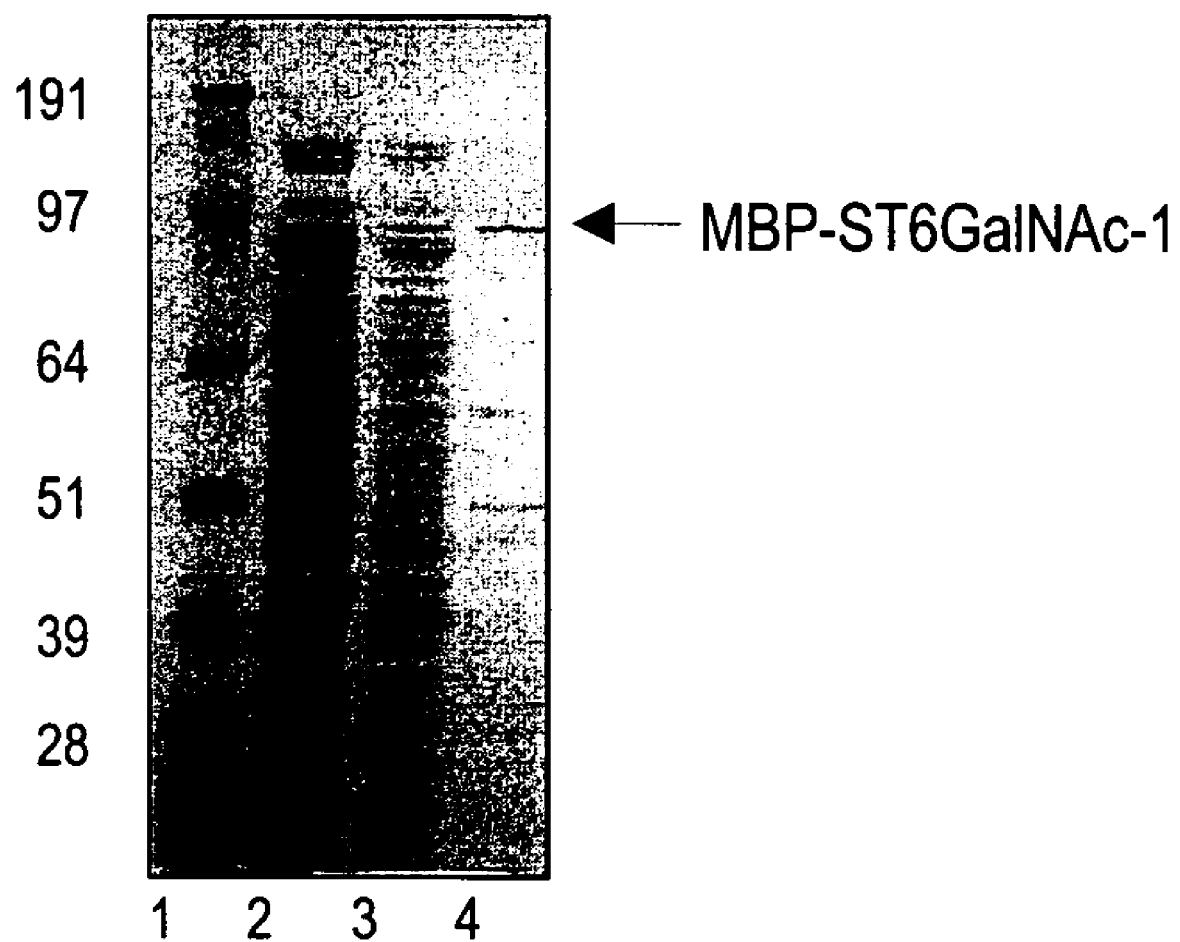
FIG. 4 demonstrates SDS-PAGE analysis of the expression and partial purification of soluble MBP-tagged truncated human ST6GalNAc-1 from trxB gor supp mutant cells. Lane 1 contains molecular weight markers. Lanes 2 and 3 are clarified lysate before and after incubation with amylose resin, respectively. Lane 4 contains partially purified MBP-ST6GalNAc-1 eluted from the amylose resin.

Previous work with MBP-tagged ST6GalNAc-1 constructs found that the fusion protein expressed as insoluble inclusion bodies in JM109 cells. The MBP-tagged truncated human ST6GalNAc-1 construct expressed in a trxB gor supp mutant strain as a soluble protein, and was partially purified on amylose resin (FIG. 4). Activity assays on the lysate sample detected sialyltransferase activity (Table 3).

TABLE 3

Yields based on observed enzyme activity of O-linked gylcan glycosyltransferases
A summary of the activities in lysate samples for the indicated fusion proteins expressed in either JM109 or trxB gor supp mutant *E. coli*. nt, not tested.

| Expressed Glycosyltransferase | Expressed in trxB gor supp mutant cells Enzyme Activity (U/L) | Expressed in JM109 cells Enzyme Activity (U/L) |
|---|---|---|
| MBP-GalNAc-T2 | 6 | nt |
| GalNAc-T2 Δ445 | 5 | nt |
| MBP-Core1-Gal-T1 | 4.2 | 0 |
| Core1-Gal-T1 | 2.5 | nt |

TABLE 3-continued

Yields based on observed enzyme activity of O-linked gylcan glycosyltransferases
A summary of the activities in lysate samples for the indicated fusion proteins expressed in either JM109 or trxB gor supp mutant *E. coli*. nt, not tested.

| Expressed Glycosyltransferase | Expressed in trxB gor supp mutant cells Enzyme Activity (U/L) | Expressed in JM109 cells Enzyme Activity (U/L) |
|---|---|---|
| MBP-ST3Gal-1 | 100 | 1.1 |
| MBP-SBD-ST3Gal-1 | 1.75 | nt |
| MBP-ST6GalNAc-1 | ~0.03 | 0 |

Figure 5:
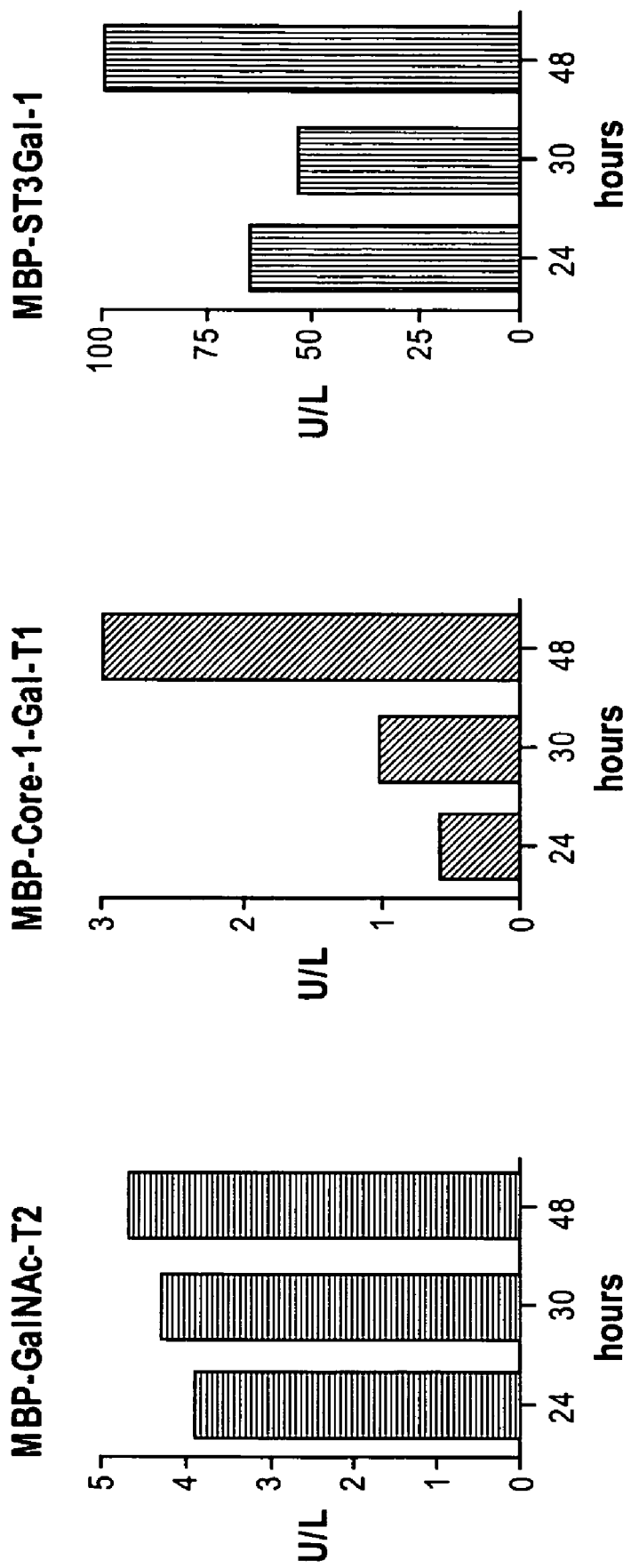
FIG. 5 provides the expressed activity yields from scale-up production experiments for MBP-GalNAc-T2, MBP-Core-1-Gal-T1, and MBP-ST3Gal-1. Ten liter fermentation vessels seeded with trxB gor supp mutant cells expressing the indicated construct were induced for 48 hours. Glycosyltransferase activity (U/liter of medium) was monitored from aliquots taken at the indicated times post-induction.

10 L Fermentation of Glycosyltransferases Expressed in trxB Gor Supp Mutant Cells Ten liter fermentation vessels were seeded with *E. coli* trxB gor supp mutant strains expressing one of the following proteins: MBP-ST3Gal-1, MBP-GalNAc-T2, and MBP-Core-1-Gal-T1. After growth at 37° C. to $OD_{620}$ of approximately 0.5 the temperature was shifted to 20° C. After the culture temperature reached 20° C., 0.1 mM IPTG was added to induce protein expression. Aliquots of cells were removed at the indicated time points (FIG. 5), processed into clarified lysates, and assayed for enzymatic activity. As shown in FIG. 5, expressed enzyme levels were maintained or increased over a 48 hour induction period for each fusion protein.

O-glycosylation and glycoPEGylation of Interferon-alpha-2b

Figure 6A:
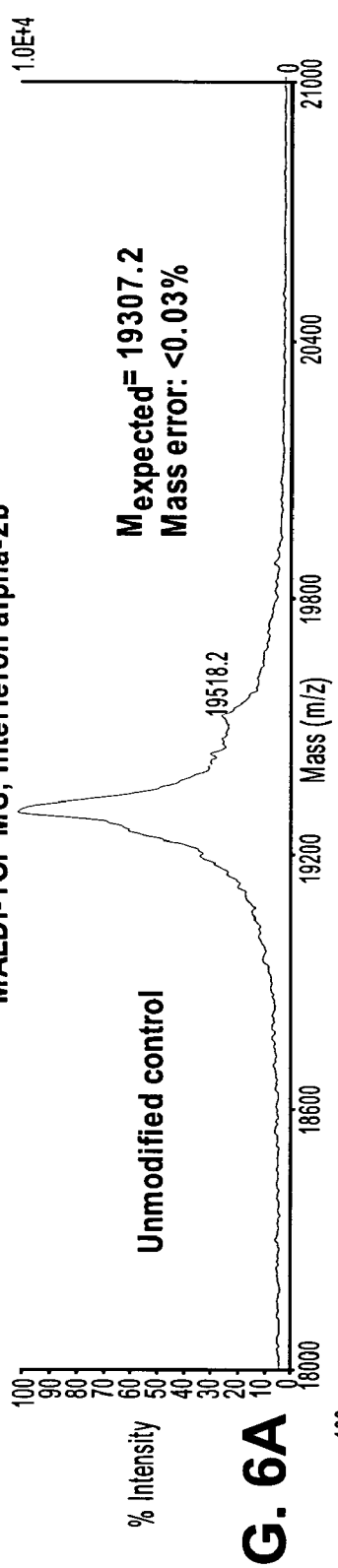
FIG. 6A shows unmodified interferon-alpha-2b.
Figure 6B:
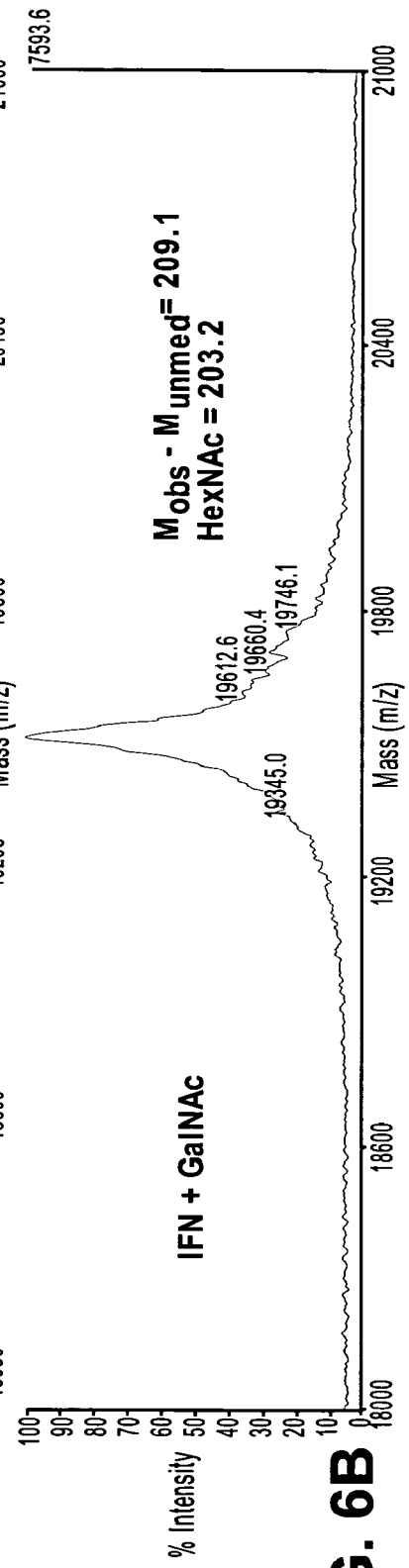
FIG. 6B shows the result of incubation with MBP-GalNAc-T2 and UDP-GalNAc.
Figure 6C:
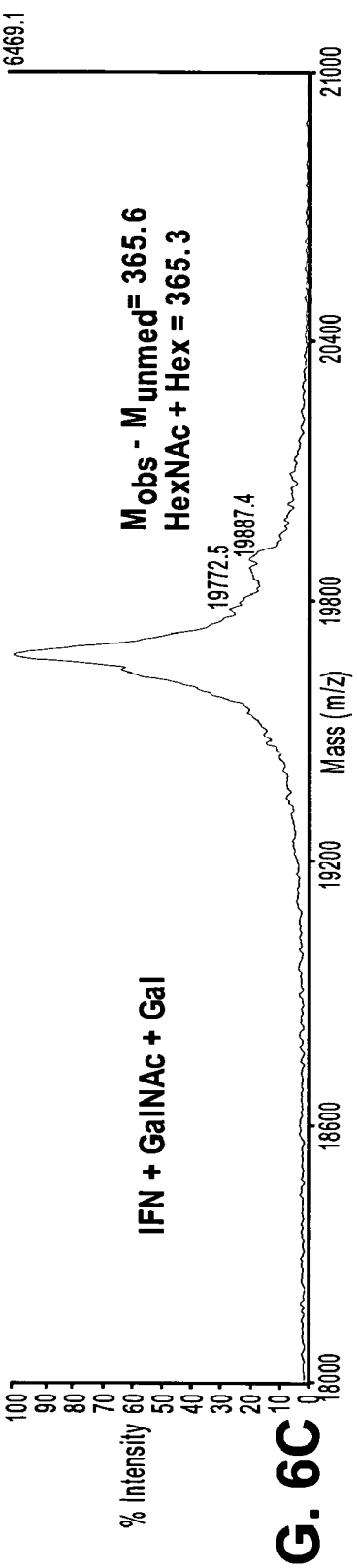
FIG. 6C shows the result of incubation with MBP-GalNAc-T2, MBP-Core-1-Gal-T1, UDP-GalNAc, and UDP-Gal. The expected mass due to addition of GalNAc (expected +203.2, observed +209.1) or GalNAc-Gal (expected +365.6, observed +365.3) to interferon-alpha-2b was observed.

Interferon-alpha-2b was glycosylated using eukaryotic glycosyltransferases that had been produced in trxB gor supp mutant *E. coli* (FIG. 6). GalNAc was first added to the interferon through the activity of the MBP-GalNAc-T2 enzyme. Galactose was then added through the activity of the MBP-Corel-Gal-T1 enzyme. The reaction products were analyzed by MALDI-TOF mass spectrometry. FIG. 6A is interferon-alpha-2b alone. The first reaction (FIG. 6B) included 40 µg interferon-alpha-2b, 0.4 mM UDP-GalNAc, and 20 mU/mg MBP-GalNAc-T2. The second reaction (FIG. 6C) included interferon-alpha-2b (40 µg), 0.4 mM UDP-GalNAc, 20 mU/mg MBP-GalNAc-T2, 0.4 mM UDP-Gal, and 20 mU/mg MBP-Corel-Gal-T1. Both reactions were carried out at 32° C. for six hours in 20 mM BisTris pH 6.7, 50 mM NaCl, 10 mM $MnCl_2$, and 0.02% $NaN_3$. As shown in FIGS. 6A and 6B, the mass peak for the interferon was increased in the first reaction, consistent with the addition of GalNAc. Similarly, in FIG. 6C, the mass of the interferon is further increased in the second reaction consistent with the addition of GalNAc-Gal.

Figure 7:
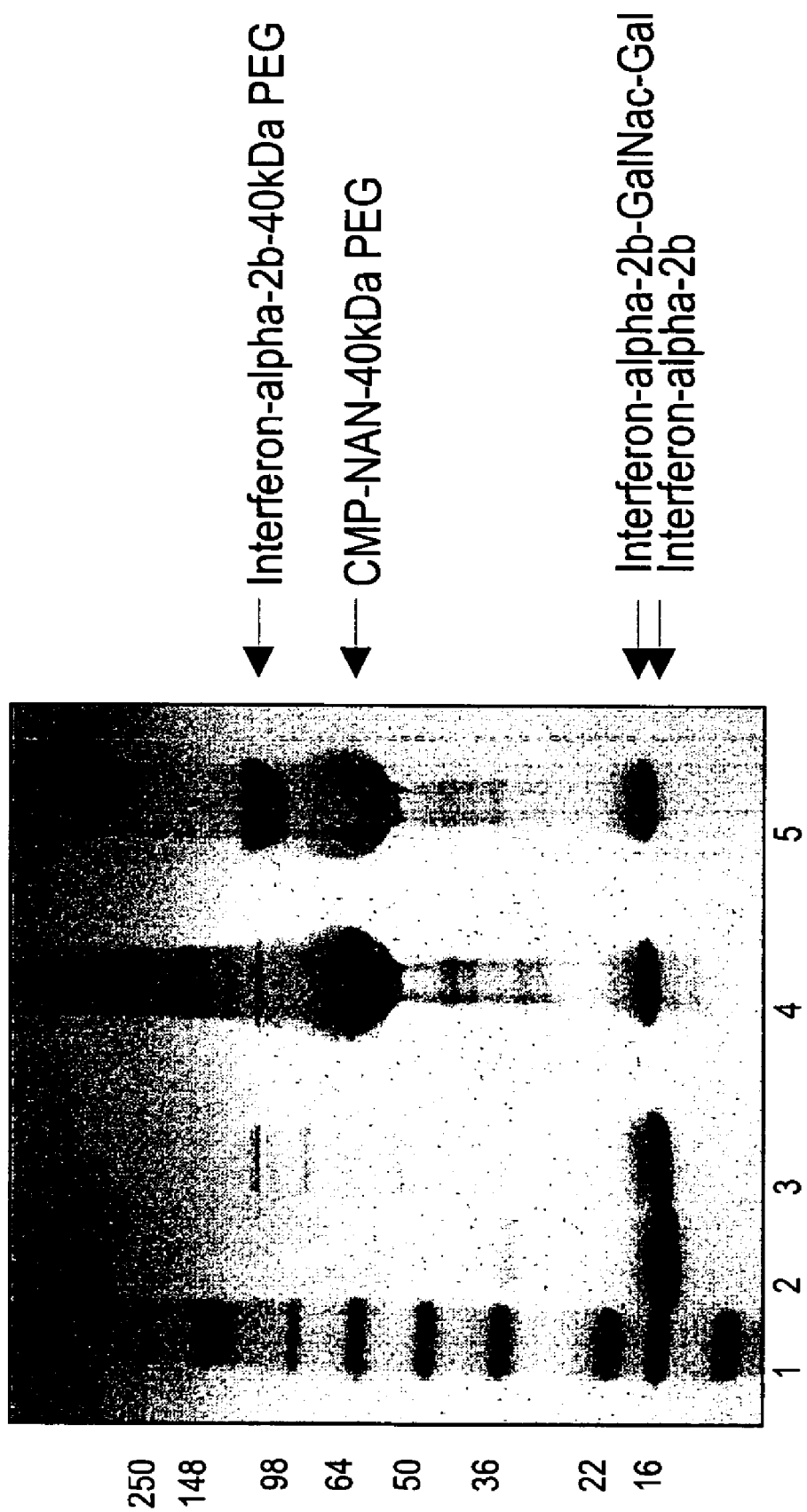
FIG. 7 demonstrates SDS-PAGE analysis of a glycoPEGylation reaction using eukaryotic glycosyltransferases produced in trxB gor supp mutant E. coli. Interferon-alpha-2b (lane 2) was first incubated with purified MBP-GalNAc-T2, MBP-Core-1-Gal-T1, UDP-GalNAc, and UDP-Gal for six hours at 32° C. (lane 3). Purified MBP-ST3Gal-1 and CMP-SA-40 kDa-PEG were then added (lane 4, zero hour time point), and incubated overnight at 32° C. to allow the glycoPEGylation reaction to proceed (lane 5). Molecular weight markers are in the first lane.

As shown in FIG. 7, the eukaryotic glycosyltransferases produced in trxB gor supp mutant *E. coli* were also used to glycoPEGylate interferon-alpha-2b. A glycosylation reaction of interferon-alpha-2b was first carried out using MBP-GalNAcT2 and MBP-Core-1-Gal-T1 produced from trxB gor supp mutant lysates. The first reaction contained 40 µg interferon-alpha-2b, 0.4 mM UDP-Gal, 20 mU/mg MBP-GalNAc-T2, 0.4 mM UDP-Gal, 20 mU/mg MBP-Corel-Gal-T1, 20 mM BisTris pH 6.7, 50 mM NaCl, 10 mM $MnCl_2$, and 0.02% $NaN_3$. After a six hour incubation at 32° C., 0.08 mM CMP-NAN-40 kDa PEG, and 50 mU/mg MBP-ST3Gal-1 were added, and the reaction continued overnight at 32° C. Reaction progress was monitored by SDS-PAGE of aliquots taken before the addition of MBP-GalNAc-T2 and MBP-Core-1-Gal-T1, immediately before and after addition of MBP-ST3Gal-1, and at the completion of the reaction. As shown in FIG. 7, lane 3, the addition of GalNAc-Gal causes a discernable reduction in the electrophoretic mobility of the interferon. The further sialylPEGylation of the interferon by MBP-ST3Gal-1 results in a dramatic reduction in mobility, consistent with the addition of 40 kDa PEG-sialic acid (FIG. 7, lane 5)

Example 2

Expression of Eukaryotic Glycosyltransferases from the N-Linked Oligosaccharide Pathway General Procedures Constructs were designed to express maltose binding protein (MBP) fusions to amino-terminal truncations of the glycosyltransferases. Constructs are designated with a Δ(number) referring to the number of amino acids removed from the amino-terminus of the corresponding native protein. The following constructs were used: human MBP-GnT 1 (Δ103), bovine MBP-GalT1 (Δ129), and rat MBP-ST3Gal3 (Δ72) and MBP—SBD-ST3Gal3 (Δ72; SBD is the starch binding domain tag, inserted between the MBP and the catalytic domain), and human MBP-ST6GalNAc-1 (Δ35). For GnT1 and GalT1, an alternate version of each enzyme bearing a single missense mutation was also tested. Nucleic acids encoding the enzymes were typically cloned into the BamHI-XhoI or BamHI-EcoRI sites of pCWin2-MBP. See, e.g., PCT/US05/00302, filed Jan. 6, 2005, which is herein incorporated by reference for all purposes. Cloning was performed using standard techniques (e.g. Current Protocols in Molecular Biology, Ausubel, F M, et al, eds. John Wiley & Sons, Inc. 1998).

Protein expression, and solubility and purification analyses were performed as described in Example 1.

For the assay of GnT1 activity, reactions were carried out using methods developed from common literature methods (e.g. Schachter, Reck, and Paulson (2003) Methods Enzymol 363, 459-475). Briefly, n-acetylglucosaminyltransferase activity was monitored as the transfer of radioactively labeled UDP-GlcNAc to Man1,6(Man1,3)Man-O-octyl (OM3). Substrate and product were purified by reverse phase, and detected and quantified using a scintillation counter.

For the assay of GalT1 activity, galactosyltransferase reactions were carried out in a mixture of enzyme sample in 50 mM HEPES pH 7.5, 4.5 mM lacto-n-triose II, 6 mM UDP-Gal, and 5 mM $MnSO_4$. Following a one hour incubation at 37° C., the reaction was stopped and the carbohydrate reaction products separated by centrifugation through a 10,000 MWCO concentrator. Substrate and product were detected and quantified by HPLC.

For the assay of ST3Gal3, sialyltransferase assays were carried out in a mixture of enzyme sample in 20 mM MOPS pH 6.5, 0.1 mg/ml BSA, 10 mM $MnCl_2$, 2 mM CMP-NAN, and 30 mM lacto-n-neotetraose. Following a two hour incubation at 30° C., the reaction was stopped by heat inactivation, and the reaction substrate and product detected and quantified by HPLC.

GnT1

Figure 8:
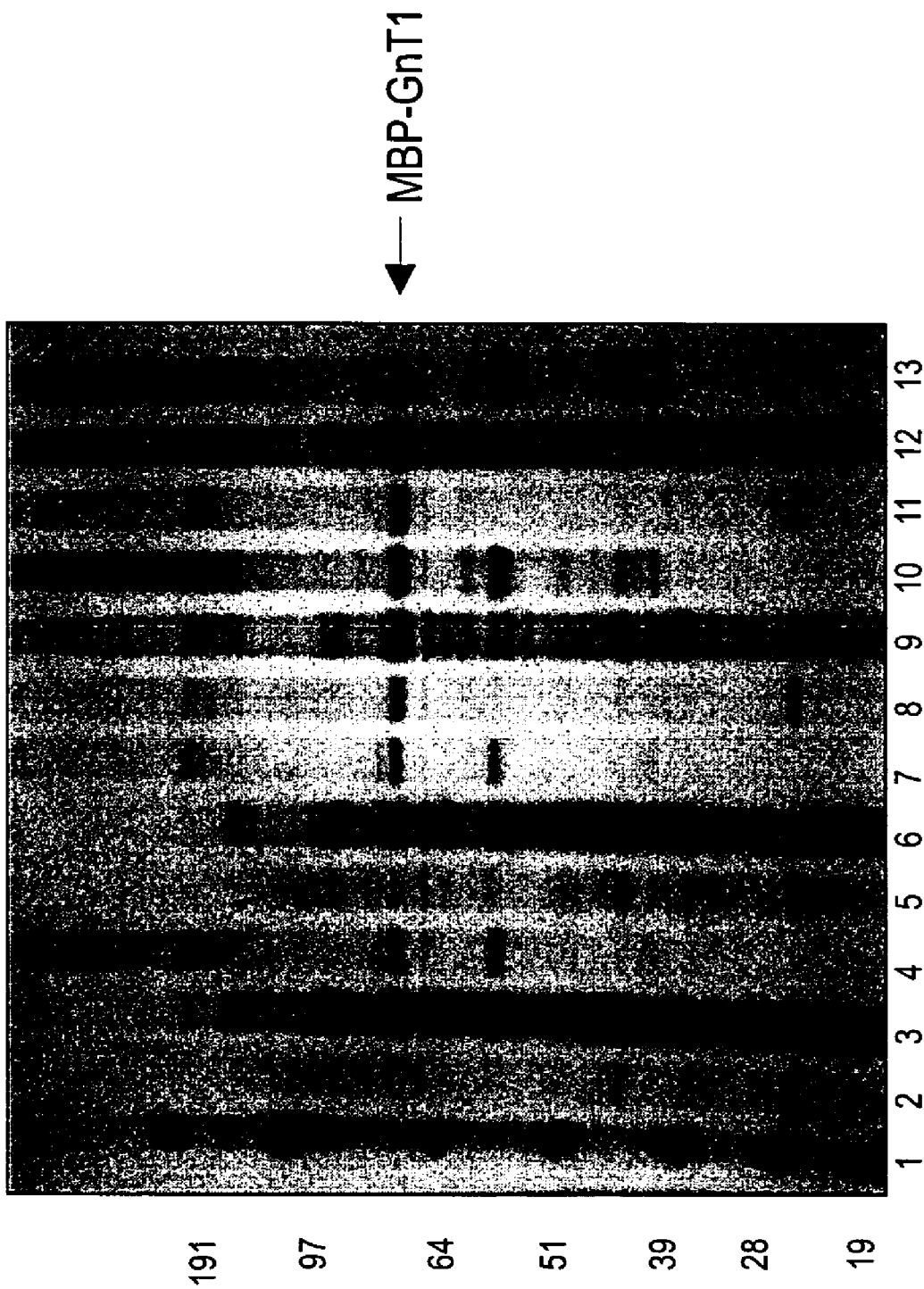
FIG. 8 provides SDS-PAGE analysis of the solubility and partial purification of MBP-tagged truncated human GnT1 (lanes 2-4, 8-10) and MBP-GnT1 C121S (lanes 5-7, 11-13) expressed in JM109 (lanes 2-7) and trxB gor supp mutant E. coli strains (lanes 8-13). Cells from induced cultures were lysed, and insoluble material separated by centrifugation (lanes 2, 5, 8, 11). Supernatants (lanes 3, 6, 9, 12) were incubated with amylose resin. Partially purified MBP fusion proteins were then eluted from the resin (lanes 4, 7, 10, 13). The first lane is molecular weight markers.

Cultures of JM109 and trxB gor supp mutant *E. coli* induced for expression of MBP-GnT1 and MBP-GnT1 C121S at 20° C. were analyzed for solubility and activity of the fusion proteins. As shown in FIG. 8, higher levels of soluble expression of both MBP-GnT1 fusion proteins were seen in the trxB gor supp mutant strain, and all of the soluble fusion proteins were recovered with amylose resin. Activity assays on the MBP-GnT1 samples indicated that the enzyme was expressed at more than 25-fold higher activity levels in trxB gor supp mutant cells than in JM109 cells (Table 4). The MBP-GnT1 C121S was also expressed as a soluble active enzyme, albeit at approximately ten-fold lower levels than the MBP-GnT1 construct in the equivalent E. coli strain (Table 4).

GalT1

Figure 9:
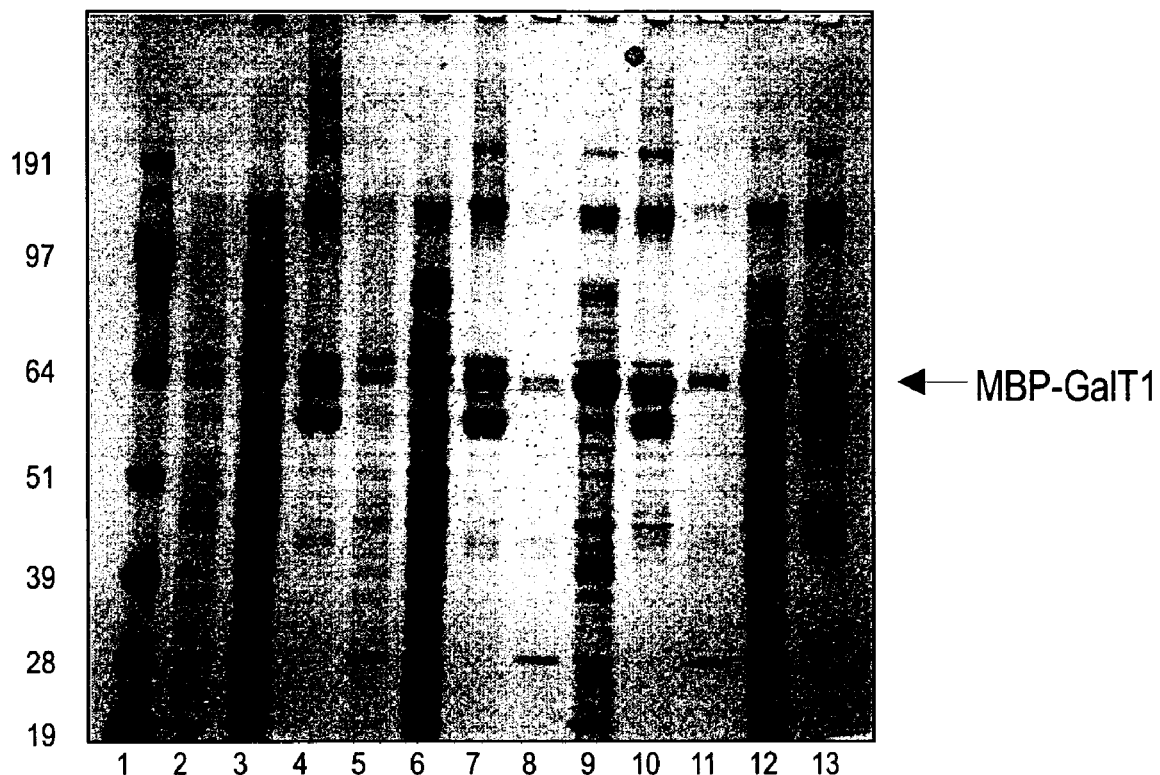
FIG. 9 provides SDS-PAGE analysis of the solubility and partial purification of MBP-tagged truncated bovine GalT1 (lanes 2-4,8-10) and MBP-GalT1 C342T (lanes 5-7, 11-13) expressed in JM109 (lanes 2-7) and trxB gor supp mutant (lanes 8-13) E. coli strains. Induced cultures were lysed and insoluble material separated by centrifugation (lanes 2, 5, 8, 11). Supernatants (lanes 3, 6, 9, 12) were incubated with amylose resin. Partially purified MBP fusion proteins were then eluted from the resin (lanes 4, 7, 10, 13). The first lane is molecular weight markers.

Cultures of JM109 and trxB gor supp mutant E. coli induced for expression of MBP-GalT1 and MBP-GalT1 C342T at 20° C. were analyzed for solubility and activity of the fusion proteins. As shown in FIG. 9, higher levels of soluble expression of both MBP-GalT1 fusion proteins were observed in the trxB gor supp mutant strain, and all of the soluble fusion proteins were recovered using amylose resin. Activity assays on MBP-GalT1 expressed in JM109 were unable to detect enzymatic activity, whereas active MBP-GalT1 enzyme was recovered from the trxB gor supp mutant expression sample (Table 4). The MBP-GalT1 C342T construct was recovered as active enzyme from both E. coli strains, with greater than five-fold higher activity levels observed in the trxB gor supp mutant samples.

ST3Gal3

Figure 10:
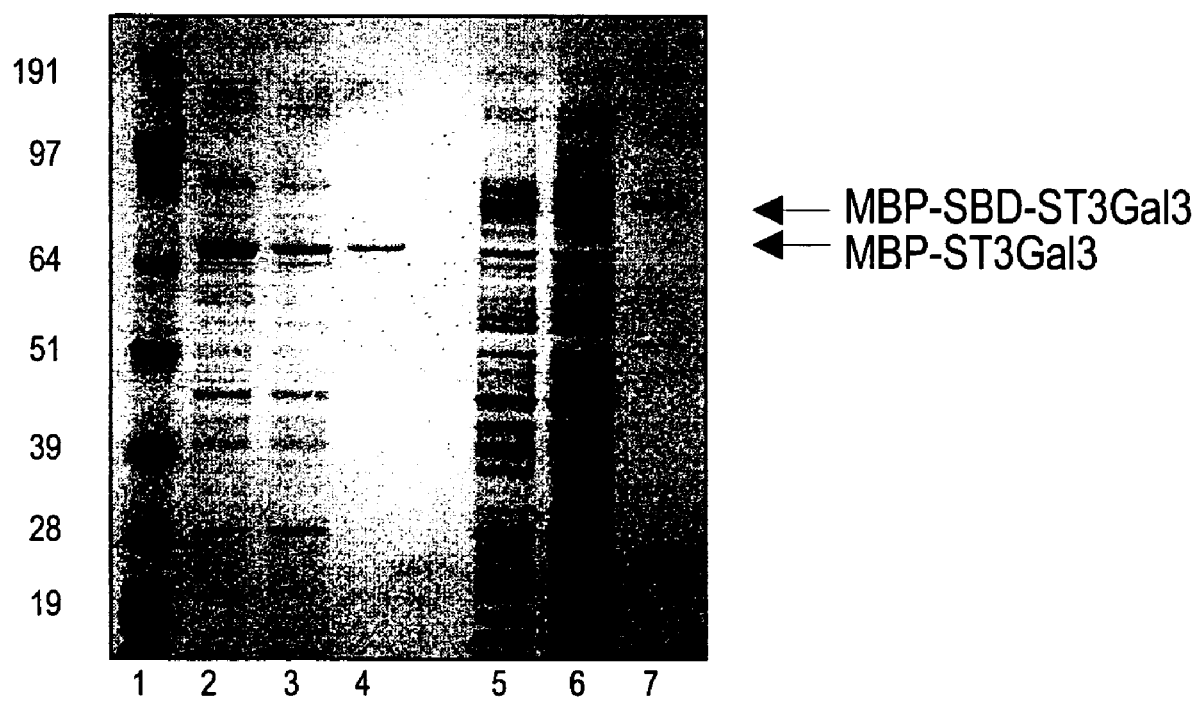
FIG. 10 provides SDS-PAGE analysis of the soluble expression and partial purification of MBP-tagged truncated rat ST3Gal3 (lanes 2-4) and MBP—SBD-tagged ST3Gal3 (lanes 5-7) expressed in a trxB gor supp mutant E. coli strain. Lanes 2-3 and 5-6 are clarified lysate before and after incubation with amylose resin, respectively. Lanes 4 and 7 are the elutions from the amylose resin containing partially purified ST3Gal3 fusion proteins. The first lane is molecular weight markers.

Cultures of trxB gor supp mutant E. coli induced for expression of MBP-ST3Gal3 and MBP—SBD-ST3Gal3 at 20° C. were analyzed for solubility and activity of the fusion proteins. As shown in FIG. 10, both versions of the ST3Gal3 fusion protein were solubly expressed in trxBgor supp mutant cells, and both were recovered on amylose resin. Both ST3Gal3 fusion proteins solubly expressed in trxB gor supp mutant cells were enzymatically active, with the MBP-tagged construct more than five-fold more active than the MBP—SBD-tagged construct (Table 4). MBP—SBD-ST3Gal3 expressed in JM109 cells had no detectable enzymatic activity (Table 4).

TABLE 4

Yields based on observed enzyme activity of N-linked glycan glycosyltransferases
A summary of the activities in lysate samples for the indicated fusion proteins expressed in either JM109 or trxB gor supp mutant E. coli. nt, not tested.

| Expressed Glycosyltransferase | Expressed in trxB gor supp mutant cells Enzyme Activity (U/L) | Expressed in JM109 cells Enzyme Activity (U/L) |
|---|---|---|
| MBP-GnT1 | 45 | 1.7 |
| MBP-GnT1 C121S | 4.3 | 0.4 |
| MBP-GalT1 | 175 | 0 |
| MBP-GalT1 C342T | 193 | 37 |
| MBP-ST3Gal3 | 4.6 | nt |
| MBP-SBD-ST3Gal3 | 0.9 | 0 |

Example 3

Expression of Eukaryotic Glycosyltransferases in Pseudomonas.

General Procedures

Activities of the following eukaryotic glycosyltransferases were tested in a Pseudomonas expression system: two N-terminal truncations of porcine ST3Gal-1, and chicken ST6GalNAc-1. Constructs, with (Δ number) referring to the number of amino acids removed from the amino-terminus of the corresponding native protein, were: porcine ST3Gal-1 (Δ45), porcine ST3Gal-1 (Δ56), and chicken ST6GalNAc-1 (Δ231). The glycosyltransferases were fused to a Pseudomonas secretion sequence wherein expression is targeted to the periplasm, and/or were expressed as unfused proteins targeted to the cytoplasm. Expression was driven by the IPTG inducible Ptac promoter. Cloning was performed using standard techniques (e.g. Current Protocols in Molecular Biology, Ausubel, F M, et al, eds. John Wiley & Sons, Inc. 1998).

Plasmids comprising nucleic acids that express the glycosyltransferases were transformed into the P. fluorescens strain DC206 (ΔpyrF, lacI$^{QI}$). See, e.g., US 2005/0186666, published Aug. 25, 2005, which is herein incorporated by reference for all purposes. The transformed cells were grown on a one liter scale in minimal (M9) medium supplemented with 1% glucose and trace elements. Following an initial growth phase, the glycosyltransferase expression was induced by addition of IPTG to the medium. Cells were grown in induction medium for between 24 and 120 hours. Cells were harvested by centrifugation, supernatants were discarded and cell pellets were frozen and stored at −20° C.

For the preparation of cell lysate, frozen cell paste (8-14 grams wet weight) was thawed and resuspended in MES lysis buffer (50 mM MES, pH 6.5) containing 100 mM NaCl at a ratio of about 1 gram wet cell paste per 2 mL lysis buffer. The suspensions were disrupted by two passages through a French pressure cell at 10,000 and 20,000 psi, respectively. Insoluble material was removed by centrifugation, and supernatants were further clarified by passage through 0.45 μm and 0.2 μm syringe filters. Samples of the insoluble and soluble fractions were analyzed by SDS-PAGE.

For the assay of sialyltransferase activity, reactions were carried out in a mixture of enzyme sample with 0.5-2 mg/ml asialo-fetuin (for ST3Gal-1) or asialo-BSM (for ST6GalNAc-1), 50 mM MES or BisTris pH 6.5, 100 mM NaCl, and radioactively-labeled CMP-NAN. Following a 30-60 minute incubation at 37° C., the reaction is stopped and the protein reaction products separated from the CMP-NAN by acid precipitation. Radioactive sialic acid transferred to asialo-fetuin or asialo-BSM was subsequently detected and quantified using a scintillation counter.

ST3Gal-1

Cell lysates from Pseudomonas cultures expressing periplasmic or cytoplasmic ST3Gal-1 constructs were assayed for sialyltransferase activity. As summarized in Table 5, sialyltransferase activity was observed in samples from both cytoplasmic- and periplasmic-targeted ST3Gal-1 Δ45 and Δ56 constructs, with higher levels of activity from the ST3Gal-1 Δ56 samples.

ST6GalNAc-1

Cell lysates from Pseudomonas cultures expressing cytoplasmic chicken ST6GalNAc-1 was assayed for sialyltransferase activity. As summarized in Table 5, sialyltransferase activity was observed in samples from cytoplasmic-targeted chick ST6GalNAc-1.

TABLE 5

Yields based on observed enzyme activity of O-linked gylcan glycosyltransferases expressed in Pseudomonas
A summary of ST3Gal-1 and ST6GalNAc-1 construct expression and activity testing using Pseudomonas.

| | Enzyme Activity (U/L) | |
|---|---|---|
| Expressed Sialyltransferase | Cytoplasmic | Periplasmic |
| porcine ST3Gal-1 Δ45 | 0.6 | 0.5 |
| porcine ST3Gal-1 Δ56 | 1.1 | 1.7 |
| chicken ST6GalNAc-1 | 0.1 | |

It is understood that the examples and embodiments described herein are for illustrative purposes only and that various modifications or changes in light thereof will be suggested to persons skilled in the art and are to be included

SEQUENCE LISTING (204 sequences)

SEQ ID NO: 1 - protein, 445 aa, Homo sapiens
  PEPTIDE (1)...(445): human beta-1,2-N-acetylglucosaminyltransferase I (GnTI, GnT1)
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPPTWEGYDPSWN

SEQ ID NO: 2 - protein, 447 aa, Oryctolagus cuniculus
  PEPTIDE (1)...(447): rabbit beta-1,2-N-acetylglucosaminyltransferase I (GnTI, GnT1)
MLKKQSAGLVLWGAILFVAWNALLLLFFWTRPVPSRLPSDNALDDDPASLTREVIRLAQDAEVELERQRGLLQQIREHHALWSQRWKVPTAAPPAQPHVPVTPPPAVIPILVIACDRSTVRRCLDKLLHYRPSAELFPIIVSQDCGHEETAQVIASYGSAVTHIRQPDLSNIAVQPDHRKFQGYYKIARHYRWALGQIFHNFNYPAAVVVEDDLEVAPDFFEYFQATYPLLKADPSLWCVSAWNDNGKEQMVDSSKPELLYRTDFFPGLGWLLLAELWAELEPKWPKAFWDDWMRRPEQRKGRACVRPEISRTMTFGRKGVSHGQFFDQHLKFIKLNQQFVPFTQLDLSYLQQEAYDRDFLARVYGAPQLQVEKVRTNDRKELGEVRVQYTGRDSFKAFAKALGVMDDLKSGVPRAGYRGIVTFLFRGRRVHLAPPQTWDGYDPSWT

SEQ ID NO: 3 - protein, 447 aa, Mus musculus
  PEPTIDE (1)...(447): mouse beta-1,2-N-acetylglucosaminyltransferase I (GnTI, GnT1)
MLKKQTAGLVLWGAIIFVGWNALLLLFFWTRPAPGRLPSDSALGDDPASLTREVIHLAEDAEAELERQRGLLQQIKEHYALWRQRWRVPTVAPPAWPRVPVTPSPVQIPILVIACDRSTVRRCLDKLLHYRPSAERFPIIVSQDCGHEETAQVIASYGTAVTHIRQPDLSNIAVQPDHRKFQGYYKIARHYRWALGQIFNKFKFPAAVVVEDDLEVAPDFFEYFQATYPLLRTDPSLWCVSAWNDNGKEQMVDSSKPELLYRTDFFPGLGWLLLADLWAELEPKWPKAFWDDWMRRPEQRKGRACIRPEISRTMTFGRKGVSHGQFFDQHLKFIKLNQQFVPFTQLDLSYLQQEAYDRDFLAQVYGAPQLQVEKVRTNDQKELGEVRVQYTSRDSFKAFAKALGVMDDLKSGVPRAGYRGIVTFQFRGRRVHLAPPQTWTGYDPSWN

SEQ ID NO: 4 - protein, 447 aa, Rattus norvegicus
  PEPTIDE (1)...(447): rat beta-1,2-N-acetylglucosaminyltransferase I (GnTI, GnT1)
MLKKQSAGLVLWGAIIFVGWNALLLLFFWTRPAPGRLPSDSALGDDPASLTREVIHLAEDAEAELERQRGLLQQIKEHYSLWRQRWRVPTVAPPAWPRVPGTPSPAVIPILVIACDRSTVRRCLDKLLHYRPSAEHFPIIVSQDCGHEETAQVIASYGTAVTHIRQPDLSNIAVQPDHRKFQGYYKIARHYRWALGQIFNKFKFPAAVVVEDDLEVAPDFFEYFQATYPLLKADPSLWCVSAWNDNGKEQMVDSSKPELLYRTDFFPGLGWLLLADLWAELEPKWPKAFWDDWMRRPEQRKGRACIRPEISRTMTFGRKGVSHGQFFDQHLKFIKLNQQFVPFTQLDLSYLQREAYDRDFLAQVYGAPQLQVEKVRTNDRKELGEVRVQYTSRDSFKAFAKALGVMDDLKSGVPRAGYRGIVTFQFRGRRVHLAPPETWNGYDPSWN

SEQ ID NO: 5 - protein, 342 aa, Artificial Sequence
  truncated human beta-1,2-N-acetylglucosaminyltransferase I (GnT1 delta103 C121S mutant)
AVIPILVIACDRSTVRRSLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFPGRRVHLAPPPTWEGYDPSWN

SEQ ID NO: 6 - protein, 342 aa, Artificial Sequence
  truncated human beta-1,2-N-acetylglucosaminyltransferase I (GnT1 delta103 C121D mutant)
AVIPILVIACDRSTVRRDLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFPGRRVHLAPPPTWEGYDPSWN

SEQ ID NO: 7 - protein, 342 aa, Artificial Sequence
  truncated human beta-1,2-N-acetylglucosaminyltransferase I (GnT1 delta103 C121T mutant)
AVIPILVIACDRSTVRRTLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFPGRRVHLAPPPTWEGYDPSWN

SEQ ID NO: 8 - protein, 342 aa, Artificial Sequence
  truncated human beta-1,2-N-acetylglucosaminyltransferase I (GnT1 delta103 C121A mutant)
AVIPILVIACDRSTVRRALDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFPGRRVHLAPPPTWEGYDPSWN

SEQ ID NO: 9 - protein, 342 aa, Artificial Sequence
  truncated human beta-1,2-N-acetylglucosaminyltransferase I (GnT1 delta103 R120A C121H double mutant)
AVIPILVIACDRSTVRAHLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFPGRRVHLAPPPTWEGYDPSWN

SEQ ID NO: 10 - protein, 735 aa, Artificial Sequence
  maltose binding protein-tagged truncated human beta-1,2-N-acetylglucosaminyltransferase I (MBP-GnT1 delta103)
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPPTWEGYDPSWN

SEQ ID NO: 11 - protein, 735 aa, Artificial Sequence [sequence omitted]

SEQ ID NO: 12 - protein, 397 aa, Homo sapiens
  PEPTIDE (1)...(397): human beta-1,4-galactosyltransferase (GalT1)
MRLREPLLSGAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 13 - protein, 399 aa, Mus musculus
  PEPTIDE (1)...(399): mouse beta-1,4-galactosyltransferase (GalT1)
MRFREQFLGGSAAMPGATLQRACRLLVAVCALHLGVTLVYYLSGRDLSRLPQLVGVSSTLQGGTNGAAASKQPPGEQRPRGARPPPPLGVSPKPRPGLDSSPGAASGPGLKSNLSSLPVPTTTGLLSLPACPEESPLLVGPMLIDFNIAVDLELLAKKNPEIKTGGRYSPKDCVSPHKVAIIIPFRNRQEHLKYWLYYLHPILQRQQLDYGIYVINQAGDTMFNRAKLLNIGFQEALKDYDYNCFVFSDVDLIPMDDRNAYRCFSQPRHISVAMDKFGFSLPYVQYFGGVSALSKQQFLAINGFPNNYWGWGGEDDDIFNRLVHKGMSISRPNAVVGRCRMIRHSRDKKNEPNPQRFDRIAHTKETMRFDGLNSLTYKVLDVQRYPLYTQITVDIGTPR

SEQ ID NO: 14 - protein, 402 aa, Bos taurus
  PEPTIDE (1)...(402): bovine beta-1,4-galactosyltransferase (GalT1)
MKFREPLLGGSAAMPGASLQRACRLLVAVCALHLGVTLVYYLAGRDLRRLPQLVGVHPPLQGSSHGAAAIGQPSGELRLRGVAPPPPLQNSSKPRSRAPSNLDAYSHPGPGPGPGSNLTSAPVPSTTTRSLTACPEESPLLVGPMLIEFNIPVDLKLIEQQNPKVKLGGRYTPMDCISPHKVAIIILFRNRQEHLKYWLYYLHPMVQRQQLDYGIYVINQAGESMFNRAKLLNVGFKEALKDYDYNCFVFSDVDLIPMNDHNTYRCFSQPRHISVAMDKFGFSLPYVQYFGGVSALSKQQFLSINGFPNNYWGWGGEDDDIYNRLAFRGMSVSRPNAVIGKCRMIRHSRDKKNEPNPQRFDRIAHTKETMLSDGLNSLTYMVLEVQRYPLYTKITVDIGTPS

SEQ ID NO: 15 - protein, 402 aa, Bos taurus; identical to SEQ ID NO: 14
  PEPTIDE (1)...(402): bovine beta-1,4-galactosyltransferase (GalT1)

SEQ ID NO: 16 - protein, 362 aa, Gallus gallus
  PEPTIDE (1)...(362): chicken beta-1,4-galactosyltransferase (GalT1, CKI)
MKEPALPGTSLQRACRLLVAFCALHLSATLLYYLAGSSLTPPRSPEPPPRRPPPANLSLPPSRPPPPPAARPRPGPVSAQPRNLPDSAPSGLCPDPSPLLVGPLRVEFSQPVNLEEVASTNPEVREGGRFAPKDCKALQKVAIIIPFRNREEHLKYWLYYMHPILQRQQLDYGVYVINQDGDEEFNRAKLLNVGFTEALKEYDYDCFVFSDVDLIPMDDRNTYKCYSQPRHLSVSMDKFGFRLPYNQYFGGVSALSKEQFTKINGFPNNYWGWGGEDDDIYNRLVFKGMGISRPDAVIGKCRMIRHSRDRKNEPNPERFDRIAHTRETMSSDGLNSLSYEVLRTDRFPLYTRITVDIGAPGS

SEQ ID NO: 17 - protein, 273 aa, Artificial Sequence
  truncated bovine beta-1,4-galactosyltransferase (GalT1 delta129)
SLTACPEESPLLVGPMLIEFNIPVDLKLIEQQNPKVKLGGRYTPMDCISPHKVAIIILFRNRQEHLKYWLYYLHPMVQRQQLDYGIYVINQAGESMFNRAKLLNVGFKEALKDYDYNCFVFSDVDLIPMNDHNTYRCFSQPRHISVAMDKFGFSLPYVQYFGGVSALSKQQFLSINGFPNNYWGWGGEDDDIYNRLAFRGMSVSRPNAVIGKCRMIRHSRDKKNEPNPQRFDRIAHTKETMLSDGLNSLTYMVLEVQRYPLYTKITVDIGTPS

SEQ ID NO: 18 - protein, 273 aa, Artificial Sequence
  truncated bovine beta-1,4-galactosyltransferase (GalT1 delta129) C342T mutant
SLTACPEESPLLVGPMLIEFNIPVDLKLIEQQNPKVKLGGRYTPMDCISPHKVAIIILFRNRQEHLKYWLYYLHPMVQRQQLDYGIYVINQAGESMFNRAKLLNVGFKEALKDYDYNCFVFSDVDLIPMNDHNTYRCFSQPRHISVAMDKFGFSLPYVQYFGGVSALSKQQFLSINGFPNNYWGWGGEDDDIYNRLAFRGMSVSRPNAVIGKTRMIRHSRDKKNEPNPQRFDRIAHTKETMLSDGLNSLTYMVLEVQRYPLYTKITVDIGTPS

SEQ ID NO: 19 - protein, 664 aa, Artificial Sequence
  maltose binding protein-tagged truncated bovine beta-1,4-galactosyltransferase (MBP-GalT1 delta129)
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFSLTACPEESPLLVGPMLIEFNIPVDLKLIEQQNPKVKLGGRYTPMDCISPHKVAIIILFRNRQEHLKYWLYYLHPMVQRQQLDYGIYVINQAGESMFNRAKLLNVGFKEALKDYDYNCFVFSDVDLIPMNDHNTYRCFSQPRHISVAMDKFGFSLPYVQYFGGVSALSKQQFLSINGFPNNYWGWGGEDDDIYNRLAFRGMSVSRPNAVIGKCRMIRHSRDKKNEPNPQRFDRIAHTKETMLSDGLNSLTYMVLEVQRYPLYTKITVDIGTPS

SEQ ID NO: 20 - protein, 664 aa, Artificial Sequence
  maltose binding protein-tagged truncated bovine beta-1,4-galactosyltransferase (MBP-GalT1 delta129) C342T mutant
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFSLTACPEESPLLVGPMLIEFNIPVDLKLIEQQNPKVKLGGRYTPMDCISPHKVAIIILFRNRQEHLKYWLYYLHPMVQRQQLDYGIYVINQAGESMFNRAKLLNVGFKEALKDYDYNCFVFSDVDLIPMNDHNTYRCFSQPRHISVAMDKFGFSLPYVQYFGGVSALSKQQFLSINGFPNNYWGWGGEDDDIYNRLAFRGMSVSRPNAVIGKTRMIRHSRDKKNEPNPQRFDRIAHTKETMLSDGLNSLTYMVLEVQRYPLYTKITVDIGTPS

SEQ ID NO: 21 - protein, 373 aa, Gallus gallus
  PEPTIDE (1)...(373): chicken beta-1,4-galactosyltransferase 2 (CKII)
MTRLLLGVTLERICKAVLLLCLLHFVIIMILYFDVYAQHLDFFSRFNARNTSRVHPFSNSSRPNSTAPSYGPRGAEPPSPSAKPNTNRSVTEKPLQPCQEMPSGLVGRLLIEFSSPMSMERVQRENPDVSLGGKYTPPDCLPRQKVAILIPFRHREHHLKYWLHYLHPILRRQKVAYGIYIINQYGEDTFNRAKLLNVGFLEALKDDEEYDCFIFSDVDLIPMDDRNLYRCYEQPRHFAVGMDKFGFRLPYAGYFGGVSGLSKSQFLKINGFPNEYWGWGGEDDDIFNRISLNGMKVSRPDIRMGRYRMIKHERDKHNEPNPQRFTKIQNTKMTMKRDGISSLQYRLVEVSRQPMYTNITVEIGRPPPRLARG

SEQ ID NO: 22 - protein, 375 aa, Homo sapiens
  PEPTIDE (1)...(375): human Gal beta-1,3-GalNAc alpha-2,3-sialyltransferase III (ST3Gal3)
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 23 - protein, 374 aa, Sus scrofa
  PEPTIDE (1)...(374): pig beta-1,3-GalNAc alpha-2,3-sialyltransferase III (ST3Gal3)
MGLLVFVRNLLLALCLFLVLGFLYYSAWKLHLLQWEDSNSVVLSFDSAGQTLGSEYDRLGFLLKLDSKLPAELATKYANFSEGACKPGYASAVMTAIFPRFSKPAPMFLDDSFRKWARIREFVPPFGIKGQDNLIKAILSVTKEYRLTPALDSLSCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLQKLVKARVITDLTSGI

SEQ ID NO: 24 - protein, 374 aa, Bos taurus
  PEPTIDE (1)...(374): cow beta-1,3-GalNAc alpha-2,3-sialyltransferase III (ST3Gal3)
MGPLIFVRNLLLALCLFLVLGFLYYSAWKLHLLQWEDSNSVVLSFDSAGQTLGSEYDRLGFLLKLDSKLPAELATKYENFSEGTCKPGYASALMTAIFPRFSKPAPMFLDDSFRKWARIREFVPPFGIKGQDNLIKAILSVTKEYRLTPALDSLSCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYEAVRMAAIRESWTHNIQREKEFLRKLVKARVITDLTSGI

SEQ ID NO: 25 - protein, 374 aa, Gallus gallus
  PEPTIDE (1)...(374): chicken beta-1,3-GalNAc alpha-2,3-sialyltransferase III (ST3Gal3)
MGLLVFMRNLLLALCLFLVLGFLYYSAWKLHLLRWEDSNSVVLSFDSVGHTIGSEYDRLGFLLKLDSKLPAELATKYANFSEGACKPGYASAVMTAIFPRFSKPAPMFLDDSFRRWARIRDFVPPFGIKGQDNLIKAILSATKDYRLTPALDSLSCRRCIIVGNGGVLANKSLGLKIDDYDVVVRLNSAPVKGFEKDVGGKTTLRITYPEGAIQKMEQYEKDSLFVLAGFKWQDFKWLKYIVYKEKVSASDGFWKSVATRVPREPHEIRILNPYFIQEAAFSFIGLPFNNGLMGRGNIPTLGSVAITMALHNCDEVAVAGLGYDMSSPNAPLHYYENIKMSAIKESWTHNIQREKEFLRKLVKARVITDLTSGI

SEQ ID NO: 26 - protein, 374 aa, Rattus norvegicus
  PEPTIDE (1)...(374): rat Gal beta-1,3-GalNAc alpha-2,3-sialyltransferase III (ST3Gal3)
MGLLVFVRNLLLALCLFLVLGFLYYSAWKLHLLQWEDSNSLILSLDSAGQTLGTEYDRLGFLLKLDSKLPAELATKYANFSEGACKPGYASAMMTAIFPRFSKPAPMFLDDSFRKWARIREFVPPFGIKGQDNLIKAILSVTKEYRLTPALDSLHCRRCIIVGNGGVLANKSLGSRIDDYDIVIRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALDGCDEVAVAGFGYDMNTPNAPLHYYETVRMAAIKESWTHNIQREKEFLRKLVKARVITDLSSGI

SEQ ID NO: 27 - protein, 374 aa, Rattus norvegicus
  PEPTIDE (1)...(374): rat Gal beta-1,3-GalNAc alpha-2,3-sialyltransferase III (ST3Gal3, ST3Gal III, SIAT3/SIAT6) D311H mutant
MGLLVFVRNLLLALCLFLVLGFLYYSAWKLHLLQWEDSNSLILSLDSAGQTLGTEYDRLGFLLKLDSKLPAELATKYANFSEGACKPGYASAMMTAIFPRFSKPAPMFLDDSFRKWARIREFVPPFGIKGQDNLIKAILSVTKEYRLTPALDSLHCRRCIIVGNGGVLANKSLGSRIDDYDIVIRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMNTPNAPLHYYETVRMAAIKESWTHNIQREKEFLRKLVKARVITDLSSGI

SEQ ID NO: 28 - protein, 374 aa, Rattus norvegicus
  PEPTIDE (1)...(374): rat Gal beta-1,3-GalNAc alpha-2,3-sialyltransferase III (ST3Gal3, ST3Gal III, SIAT3/SIAT6) V162I mutant
MGLLVFVRNLLLALCLFLVLGFLYYSAWKLHLLQWEDSNSLILSLDSAGQTLGTEYDRLGFLLKLDSKLPAELATKYANFSEGACKPGYASAMMTAIFPRFSKPAPMFLDDSFRKWARIREFVPPFGIKGQDNLIKAILSVTKEYRLTPALDSLHCRRCIIIGNGGVLANKSLGSRIDDYDIVIRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALDGCDEVAVAGFGYDMNTPNAPLHYYETVRMAAIKESWTHNIQREKEFLRKLVKARVITDLSSGI

SEQ ID NO: 29 - protein, 374 aa, Rattus norvegicus
  PEPTIDE (1)...(374): rat Gal beta-1,3-GalNAc alpha-2,3-sialyltransferase III (ST3Gal3) V162I D311H mutant
MGLLVFVRNLLLALCLFLVLGFLYYSAWKLHLLQWEDSNSLILSLDSAGQTLGTEYDRLGFLLKLDSKLPAELATKYANFSEGACKPGYASAMMTAIFPRFSKPAPMFLDDSFRKWARIREFVPPFGIKGQDNLIKAILSVTKEYRLTPALDSLHCRRCIIIGNGGVLANKSLGSRIDDYDIVIRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMNTPNAPLHYYETVRMAAIKESWTHNIQREKEFLRKLVKARVITDLSSGI

SEQ ID NO: 30 - protein, 302 aa, Artificial Sequence
  truncated rat Gal beta-1,3-GalNAc alpha-2,3-sialyltransferase III (ST3Gal3 delta72) V162I D311H mutant
LATKYANFSEGACKPGYASAMMTAIFPRFSKPAPMFLDDSFRKWARIREFVPPFGIKGQDNLIKAILSVTKEYRLTPALDSLHCRRCIIIGNGGVLANKSLGSRIDDYDIVIRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMNTPNAPLHYYETVRMAAIKESWTHNIQREKEFLRKLVKARVITDLSSGI

SEQ ID NO: 31 - protein, 695 aa, Artificial Sequence
  maltose binding protein-tagged truncated rat Gal beta-1,3-GalNAc alpha-2,3-sialyltransferase III (MBP-ST3Gal3 delta72) V162I D311H mutant
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSLATKYANFSEGACKPGYASAMMTAIFPRFSKPAPMFLDDSFRKWARIREFVPPFGIKGQDNLIKAILSVTKEYRLTPALDSLHCRRCIIIGNGGVLANKSLGSRIDDYDIVIRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMNTPNAPLHYYETVRMAAIKESWTHNIQREKEFLRKLVKARVITDLSSGI

SEQ ID NO: 32 - protein, 845 aa, Artificial Sequence
  maltose binding protein-starch binding domain-tagged truncated rat Gal beta-1,3-GalNAc alpha-2,3-sialyltransferase III (MBP-SBD-ST3Gal3 delta72) V162I D311H mutant
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWRGSLATKYANFSEGACKPGYASAMMTAIFPRFSKPAPMFLDDSFRKWARIREFVPPFGIKGQDNLIKAILSVTKEYRLTPALDSLHCRRCIIIGNGGVLANKSLGSRIDDYDIVIRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMNTPNAPLHYYETVRMAAIKESWTHNIQREKEFLRKLVKARVITDLSSGI

SEQ ID NO: 33 - protein, 571 aa, Homo sapiens
  PEPTIDE (1)...(571): human UDP-N-acetylgalactosaminyltransferase 2 (GalNAc-T2)
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 34 - protein, 633 aa, Drosophila sp.
  PEPTIDE (1)...(633): Drosophila UDP-N-acetylgalactosaminyltransferase 2 (GalNAc-T2)
MRRNIKLIVFVSIIWMFVMVYYFQSSTEKVENRALRLREVATAMQQYQDDSSSAAAASTARQWAPAGGGAGPGAAAGAAGSGADDPGGNVILIGSVKDFERNAVHGLKLNGIVALEETSQGLSGGTGGPGGRLPVAPSGRGTEVEYFNEAGYIRAGALRNGEDPYIRNRFNQEASDALPSNRDIPDTRNPMCRTKKYREDLPETSVIITFHNEARSTLLRTIVSVLNRSPEHLIREIVLVDDYSDHPEDGLELAKIDKVRVIRNDKREGLVRSRVKGADAAVSSVLTFLDSHVECNEMWLEPLLERVREDPTRVVCPVIDVISMDNFQYIGASADLRGGFDWNLIFKWEYLSPSERAMRHNDPTTAIRTPMIAGGLFVIDKAYFNKLGKYDMKMDVWGGENLEISFRVWQCGGSLEIIPCSRVGHVFRKRHPYTFPGGSGNVFARNTRRAAEVWMDDYKQHYYNAVPLAKNIPFGNIDDRLALKEKLHCKPFKWYLENVYPDLQAPDPQEVGQFRQDSTECLDTMGHLIDGTVGIFPCHNTGGNQEWAFTKRGEIKHDDLCLTLVTFARGSQVVLKACDDSENQRWIMREGGLVRHYKINVCLDSRDQSQQGVSAQHCNSALGTQRWSFGKYA

SEQ ID NO: 35 - protein, 570 aa, Mus musculus
  PEPTIDE (1)...(570): mouse UDP-N-acetylgalactosaminyltransferase 2 (GalNAc-T2)
MRRRSRMLLCFALLWVLGIAYYMYSGGGSALAAGGGGAGRKGDWNDIDSIKKKDLHHSRGDEKAQGVETLPPGKVRWPDFNQEAYVGGTMVRSGQDPYARNKFNQVESDKLHMDRGIPDTRHDQCQRKQWRVDLPATSVVITFHNEARSALLRTVVSVLKRSPPHLIKEIILVDDYSNDPEDGALLGKIEKVRVLRNDRREGLMRSRVRGADAAQAKVLTFLDSHCECNERWLEPLLERVAEDRTRVVSPIIDVINMDNFQYVGASADLKGGFDWNLVFKWDYMTPEQRRSRQGNPVAPIKTPMIAGGLFVMDKLYFEELGKYDMMMDVWGGENLEISFRVWQCGGSLEIIPCSRVGHVFRKQHPYTFPGGSGTVFARNTRRAAEVWMDEYKHFYYAAVPSARNVPYGNIQSRLELRKKLGCKPFKWYLDNVYPELRVPDHQDIAFGALQQGTNCLDTLGHFADGVVGIYECHNAGGNQEWALTKEKSVKHMDLCLTVVDRSPGSLIRLQGCRENDSRQKWEQIEGNSKLRHVGSNLCLDSRTAKSGGLSVEVCGPALSQQWKFSLNLQQ

SEQ ID NO: 36 - protein, 520 aa, Artificial Sequence
  truncated human UDP-N-acetylgalactosaminyltransferase 2 (GalNAc-T2 delta51)
KKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 37 - protein, 393 aa, Artificial Sequence
  truncated human UDP-N-acetylgalactosaminyltransferase 2 (GalNAc-T2 delta1-51 delta445-571)
KKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQD

SEQ ID NO: 38 - protein, 522 aa, Artificial Sequence
  truncated human UDP-N-acetylgalactosaminyltransferase 2 (GalNAc-T2 delta51) alternate form
MSKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 39 - protein, 395 aa, Artificial Sequence
  truncated human UDP-N-acetylgalactosaminyltransferase 2 (GalNAc-T2 delta1-51 delta445-571) alternate form
MSKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQD

SEQ ID NO: 40 - protein, 913 aa, Artificial Sequence
  maltose binding protein-tagged truncated human UDP-N-acetylgalactosaminyltransferase 2 (MBP-GalNAc-T2 delta51)
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 41 - protein, 363 aa, Homo sapiens
  PEPTIDE (1)...(363): human UDP-galactose:N-acetylgalactosamine-alpha-R beta-1,3-galactosyltransferase (Core-1-Gal-T1)
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEGPGCCSDLAVSFHYVDSTTMYELEYLVYHLRPYGYLYRYQPTLPERILKEISQANKNEDTKVKLGNP

SEQ ID NO: 42 - protein, 388 aa, Drosophila sp.
  PEPTIDE (1)...(388): Drosophila UDP-galactose:N-acetylgalactosamine-alpha-R beta-1,3-galactosyltransferase (Core-1-Gal-T1)
MTANSLLGRSILNEGRSNKRSFVSLIVGLIVGFCLAELFVYSTPERSEFMPYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSAETKTQ

SEQ ID NO: 43 - protein, 363 aa, Mus musculus
  PEPTIDE (1)...(363): mouse UDP-galactose:N-acetylgalactosamine-alpha-R beta-1,3-galactosyltransferase (Core-1-Gal-T1)
MASKSWLNFLVFLCGSAIGFFLCSQLLSILLREEAAIQPNMLHNDPHARHSDDNGHSHLKGQMNFNADSSQHKDENIDVAENLYQKVKILCWVMTSPQNLEKKAKHVKATWAQRCNKVLFMSSEENQDFPTVGLKTKEGREQLYWKTIKAFQYVHDHYLEDADWFMKADDDTYVIVDNLRWLLSKYDPEQPIYFGRRFKPYVKQGYMSGGAGYVLSKEALRRFVNAFKTEKCTHSSSIEDLALGRCMEIINVEAGDSRDTIGKETFHPFVPEHHLIKGYLPKTFWYWNYNYYPPIEGPGCCSDIAVSFHYVDGTTMYELEYLVYRLRPYGCLYRYQPALPENILKEINQVNRKEDTKIKLGNP

SEQ ID NO: 44 - protein, 363 aa, Rattus norvegicus
  PEPTIDE (1)...(363): rat UDP-galactose:N-acetylgalactosamine-alpha-R beta-1,3-galactosyltransferase (Core-1-Gal-T1)
MASKSWLNFLTFLCGSAIGFFLCSQLLNILLQEQADVQPNMLHNDPHARHSDDSGHNHLKGQMDFNADSSQHKDENTDVAENLYQKVKVLCWVMTSPQNLEKKAKHVKATWAQRCNKVLFMSSEENKDFPTVGLETKEGREQLYWKTIKAFQYVHDHYLEDADWFMKADDDTYVILDNLRWLLSKYNPEQPIYFGRRFKPYVKQGYMSGGAGYVLSKEALRRFVDAFKTEKCTHSSSIEDLALGRCMEIIKVEAGDSRDPTGKETFHPFVPEHHLIKGYLPKTFWYWNYNYYPPVEGPGCCSDIAVSFHYVDSTTMYELEYLVYHLRPYGYLYRYQPALPENILKEINQVNKKEDTKIKLGNP

SEQ ID NO: 45 - protein, 388 aa, Drosophila sp.
  PEPTIDE (1)...(388): Drosophila UDP-galactose:N-acetylgalactosamine-alpha-R beta-1,3-galactosyltransferase (Core-1-Gal-T1) A383T mutant
MTANSLLGRSILNEGRSNKRSFVSLIVGLIVGFCLAELFVYSTPERSEFMPYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSTETKTQ

SEQ ID NO: 46 - protein, 357 aa, Artificial Sequence
  truncated Drosophila UDP-galactose:N-acetylgalactosamine-alpha-R beta-1,3-galactosyltransferase (Core-1-Gal-T1 delta31) A383T mutant
GFCLAELFVYSTPERSEFMPYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSTETKTQ

SEQ ID NO: 47 - protein, 358 aa, Artificial Sequence
  truncated Drosophila UDP-galactose:N-acetylgalactosamine-alpha-R beta-1,3-galactosyltransferase (Core-1-Gal-T1 delta31) A383T mutant alternate form
MGFCLAELFVYSTPERSEFMPYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSTETKTQ

SEQ ID NO: 48 - protein, 338 aa, Artificial Sequence
  truncated Drosophila UDP-galactose:N-acetylgalactosamine-alpha-R beta-1,3-galactosyltransferase (Core-1-Gal-T1 delta50)
PYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSAETKTQ

SEQ ID NO: 49 - protein, 338 aa, Artificial Sequence
  truncated Drosophila UDP-galactose:N-acetylgalactosamine-alpha-R beta-1,3-galactosyltransferase (Core-1-Gal-T1 delta50) A383T mutant
PYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSTETKTQ

SEQ ID NO: 50 - protein, 340 aa, Artificial Sequence
  truncated Drosophila UDP-galactose:N-acetylgalactosamine-alpha-R beta-1,3-galactosyltransferase (Core-1-Gal-T1 delta50) A383T mutant alternate form
MSPYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSTETKTQ

SEQ ID NO: 51 - protein, 731 aa, Artificial Sequence
  maltose binding protein-tagged truncated Drosophila UDP-galactose:N-acetylgalactosamine-alpha-R beta-1,3-galactosyltransferase (MBP-Core-1-Gal-T1 delta50) A383T mutant
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSPYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSTETKTQ

SEQ ID NO: 52 - protein, 318 aa, Homo sapiens
  PEPTIDE (1)...(318): human Core-1-Gal-T1 chaperone 1/COSMC
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFDKYRDQYNWFFLARPTTFAIIENLKYFLLKKDPSQPFYLGHTIKSGDLEYVGMEGGIVLSVESMKRLNSLLNIPEKCPEQGGMIWKISEDKQLAVCLKYAGVFAENAEDADGKDVFNTKSVGLSIKEAMTYHPNQVVEGCCSDMAVTFNGLTPNQMHVMMYGVYRLRAFGHIFNDALVFLPPNGSDND

SEQ ID NO: 53 - protein, 340 aa, Homo sapiens
  PEPTIDE (1)...(340): human Gal beta-1,3-GalNAc alpha-2,3-sialyltransferase 1 (ST3Gal-1)
MVTLRKRTLKVLTFLVLFIFLTSFFLNYSHTMVATTWFPKQMVLELSENLKRLIKHRPCTCTHCIGQRKLSAWFDERFNQTMQPLLTAQNALLEDDTYRWWLRLQREKKPNNLNDTIKELFRVVPGNVDPMLEKRSVGCRRCAVVGNSGNLRESSYGPEIDSHDFVLRMNKAPTAGFEADVGTKTTHHLVYPESFRELGDNVSMILVPFKTIDLEWVVSAITTGTISHTYIPVPAKIRVKQDKILIYHPAFIKYVFDNWLQGHGRYPSTGILSVIFSMHVCDEVDLYGFGADSKGNWHHYWENNPSAGAFRKTGVHDADFESNVTATLASINKIRIFKGR

SEQ ID NO: 54 - protein, 343 aa, Sus scrofa
  PEPTIDE (1)...(343): porcine Gal beta-1,3-GalNAc alpha-2,3-sialyltransferase 1 (ST3Gal-1)
MAPMRKKSTLKLLTLLVLFIFLTSFFLNYSHTVVTTAWFPKQMVIELSENFKKLMKYPYRPCTCTRCIEEQRVSAWFDERFNRSMQPLLTAKNAHLEEDTYKWWLRLQREKQPNNLNDTIRELFQVVPGNVDPLLEKRLVSCRRCAVVGNSGNLKESYYGPQIDSHDFVLRMNKAPTEGFEADVGSKTTHHFVYPESFRELAQEVSMILVPFKTTDLEWVISATTTGTISHTYVPVPAKIKVKKEKILIYHPAFIKYVFDRWLQGHGRYPSTGILSVIFSLHICDEVDLYGFGADSKGNWHHYWENNPSAGAFRKTGVHDGDFESNVTTILASINKIRIFKGR

SEQ ID NO: 55 - protein, 337 aa, Mus musculus
  PEPTIDE (1)...(337): mouse Gal beta-1,3-GalNAc alpha-2,3-sialyltransferase 1 (ST3Gal-1)
MRRKTLKYLTFFLLFIFLTSFVLNYSNTGVPSAWFPKQMLLELSENFRRFIKSQPCTCRHCISQDKVSYWFDQRFNKTMQPLLTVHNALMEEDTYRWWLRLQRERKPNNLSDTVKELFRLVPGNVDPMLNKRLVGCRRCAVVGNSGNLKDSSYGPEIDSHDFVLRMNKAPTVGFEADVGSRTTHHLVYPESFRELGENVNMVLVPFKTTDLQWVISATTTGTITHTYVPVPPKIKVKQEKILIYHPAFIKYVFDNWLQGHGRYPSTGILSIIFSIHICDEVDLYGFGADSKGNWHHYWENNPSAGAFRKTGVHDGDFEYNITTTLAAINKIRIFKGR

SEQ ID NO: 56 - protein, 340 aa, Rattus norvegicus
  PEPTIDE (1)...(340): rat Gal beta-1,3-GalNAc alpha-2,3-sialyltransferase 1 (ST3Gal-1)
MVNMRKRTLKYLTFFLLFIFLTSFVLNYSNSGVPSAWFPKQMVLEFSENFRKFIKSQPCTCRHCISQGKVSYWFDQRFNKTMQPLLTVHNALMEEDTYRWWLRLQRERKPNNLSDTVKELFRLVPGNVDPMLNKRLVGCRRCAVVGNSGNLKDSSYGPEIDSHDFVLRMNRAPTVGFEADVGSRTTHHLVYPESFRELGENVNMVLVPFKITDLQWVISATTTGTITHTYVPVPPKIKVKQEKILIYHPAFIKYVFDNWLQGHGRYPSTGILSVIFSIHICDEVDLYGFGADSKGNWHHYWENNPSAGAFRKTGVHDGDFEYNVTTTLAAINKIRIFKGR

SEQ ID NO: 57 - protein, 340 aa, Pan troglotytes
  PEPTIDE (1)...(340): chimp Gal beta-1,3-GalNAc alpha-2,3-sialyltransferase 1 (ST3Gal-1)
MVTLRKRTLKVLTFLVLFIFLTSFFLNYSHTMVATTWFPKQMVLELSENLKRLIKHRPCTCTHCIGQRKLSAWFDERFNQTVQPLLTAQNALLEDDTYRWWLRLQREKKPNNLNDTIKELFRVVPGNVDPMLEKRSVGCRRCAVVGNSGNLRESSYGPEIDSHDFVLRMNKAPTAGFEADVGTKTTHHLVYPESFRELGDNVSMILVPFKTIDLEWVVSAITTGTISHTYTPVLVKIRVKQDKILIYHPAFIKYVFDNWLQGHGRYPSTGILSVIFSMHVCDEVDLYGFGADSKGNWHHYWENNPSAGAFRKTGVHDADFESNVTATLAAINKIRIFKGR

SEQ ID NO: 58 - protein, 298 aa, Artificial Sequence
  truncated pig Gal beta-1,3-GalNAc alpha-2,3-sialyltransferase 1 (ST3Gal-1 delta45)
ELSENFKKLMKYPYRPCTCTRCIEEQRVSAWFDERFNRSMQPLLTAKNAHLEEDTYKWWLRLQREKQPNNLNDTIRELFQVVPGNVDPLLEKRLVSCRRCAVVGNSGNLKESYYGPQIDSHDFVLRMNKAPTEGFEADVGSKTTHHFVYPESFRELAQEVSMILVPFKTTDLEWVISATTTGTISHTYVPVPAKIKVKKEKILIYHPAFIKYVFDRWLQGHGRYPSTGILSVIFSLHICDEVDLYGFGADSKGNWHHYWENNPSAGAFRKTGVHDGDFESNVTTILASINKIRIFKGR

SEQ ID NO: 59 - protein, 287 aa, Artificial Sequence
  truncated pig Gal beta-1,3-GalNAc alpha-2,3-sialyltransferase 1 (ST3Gal-1 delta56)
YPYRPCTCTRCIEEQRVSAWFDERFNRSMQPLLTAKNAHLEEDTYKWWLRLQREKQPNNLNDTIRELFQVVPGNVDPLLEKRLVSCRRCAVVGNSGNLKESYYGPQIDSHDFVLRMNKAPTEGFEADVGSKTTHHFVYPESFRELAQEVSMILVPFKTTDLEWVISATTTGTISHTYVPVPAKIKVKKEKILIYHPAFIKYVFDRWLQGHGRYPSTGILSVIFSLHICDEVDLYGFGADSKGNWHHYWENNPSAGAFRKTGVHDGDFESNVTTILASINKIRIFKGR

SEQ ID NO: 60 - protein, 691 aa, Artificial Sequence
  maltose binding protein-tagged truncated pig Gal beta-1,3-GalNAc alpha-2,3-sialyltransferase 1 (MBP-ST3Gal-1 delta45)
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSELSENFKKLMKYPYRPCTCTRCIEEQRVSAWFDERFNRSMQPLLTAKNAHLEEDTYKWWLRLQREKQPNNLNDTIRELFQVVPGNVDPLLEKRLVSCRRCAVVGNSGNLKESYYGPQIDSHDFVLRMNKAPTEGFEADVGSKTTHHFVYPESFRELAQEVSMILVPFKTTDLEWVISATTTGRISHTYVPVPAKIKVKKEKILIYHPAFIKYVFDRWLQGHGRYPSTGILSVIFSLHICDEVDLYGFGADSKGNWHHYWENNPSAGAFRKTGVHDGDFESNVTTILASINKIRIFKGR

SEQ ID NO: 61 - protein, 841 aa, Artificial Sequence
  maltose binding protein-starch binding domain-tagged truncated pig Gal beta-1,3-GalNAc alpha-2,3-sialyltransferase 1 (MBP-SBD-ST3Gal-1 delta45)
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWRGSELSENFKKLMKYPYRPCTCTRCIEEQRVSAWFDERFNRSMQPLLTAKNAHLEEDTYKWWLRLQREKQPNNLNDTIRELFQVVPGNVDPLLEKRLVSCRRCAVVGNSGNLKESYYGPQIDSHDFVLRMNKAPTEGFEADVGSKTTHHFVYPESFRELAQEVSMILVPFKTTDLEWVISATTTGRISHTYVPVPAKIKVKKEKILIYHPAFIKYVFDRWLQGHGRYPSTGILSVIFSLHICDEVDLYGFGADSKGNWHHYWENNPSAGAFRKTGVHDGDFESNVTTILASINKIRIFKGR

SEQ ID NO: 62 - protein, 600 aa, Homo sapiens
  PEPTIDE (1)...(600): human alpha-N-acetylgalactosaminide alpha-2,6-sialyltransferase I (ST6GalNAc-1)
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRYLLLHPDFLRYMKNRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 63 - protein, 600 aa, Artificial Sequence
  human N-acetylgalactosamine-alpha-2,6-sialyltransferase I (ST6GalNAcI), from pcDNA3.1(+)ST6GalNAcI-N1C1#1
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTKGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHIGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRYLLLHPDFLRYMKNRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 64 - protein, 526 aa, Mus musculus
  PEPTIDE (1)...(526): mouse alpha-N-acetylgalactosaminide alpha-2,6-sialyltransferase I (ST6GalNAc-1)
  MOD_RES (441)...(441): Xaa = any amino acid
MTRYCRGLSQRQAFLLLTVLALLFILLFVVKDPRAKDSRRQFILNNDSSAQEILQKAEPQGPIMTLSPRVHNKEATSVSSKDLKKQEREAVQGEQAEGKEKRKLETIRPAPENPQSKAEPAAKTPVSEHLDKVPRTPGALSTRKTPMATGAVPAKKKVVQATKSPASSPHPTTRRRQRLKASEFKSEPRWDFEEEYSLDMSSLQTNCSASVKIKASKSPWLQNIFLPNITLFLDSGRFTQSEWNRLEHFAPPFGFMELNQSLVQKVVTRFPPVRQQQLLLASLPTGYSKCITCAVVGNGGILNDSRVGREIDSHDYVFRLSGAVIKGYEQDVGTRTSFYGFTAFSLTQSILILGRRGFQHVPLGKDVRYLHFLEGTRNYEWLEAMFLNQTLAKTHLSWFRHRPQEAFRNALDLDRYLLLHPDFLRYMKNRFLRSKTLDTAXWRIYRPTTGALLLLTALHLCDKVSAYGFITEGHERFSDHYYDTSWKRLIFYINHDFRLERMVWKRLHDEGIIWLYQRPQSDKAKN

SEQ ID NO: 65 - protein, 566 aa, Gallus gallus
  PEPTIDE (1)...(566): chicken alpha-N-acetylgalactosaminide alpha-2,6-sialyltransferase I (ST6GalNAc-1)
MGFLIRRLPKDSRIFRWLLILTVFSFIITSFSALFGMEKSIFRQLKIYQSIAHMLQVDTQDQQGSNYSANGRISKVGLERDIAWLELNTAVSTPSGEGKEEQKKTVKPVAKVEEAKEKVTVKPFPEVMGITNTTASTASVVERTKEKTTARPVPGVGEADGKRTTIALPSMKEDKEKATVKPSFGMKVAHANSTSKDKPKAEEPPASVKAIRPVTQAATVTEKKKLRAADFKTEPQWDFDDEYILDSSSPVSTCSESVRAKAAKSDWLRDLFLPNITLFIDKSYFNVSEWDRLEHFAPPYGFMELNYSLVEEVMSRLPPNPHQQLLLANSSSNVSTCISCAVVGNGGILNNSGMGQEIDSHDYVFRVSGAVIKGYEKDVGTKTSFYGFTAYSLVSSLQNLGHKGFKKIPQGKHIRYIHFLEAVRDYEWLKALLLDKDIRKGFLNYYGRRPRERFDEDFTMNKYLVAHPDFLRYLKNRFLKSKNLQKPYWRLYRPTTGALLLLTALHLCDRVSAYGYITEGHQKYSDHYYDKEWKRLVFYVNHDFNLEKQVWKRLHDENIMKLYQRS

SEQ ID NO: 66 - protein, 519 aa, Rattus norvegicus
  PEPTIDE (1)...(519): rat alpha-N-acetylgalactosaminide alpha-2,6-sialyltransferase I (ST6GalNAc-1)
MENRCRGLSQGQTFLLLTGLMLLFILPSVVKEPSTRVSRQFIEDNESSLQGVPQKPAPQGPIVTLTPTVHNKKTTSVRTKWVELQKQDRATARGERGEGVEKKLQAIRLAPENPKGKAEPEVKTPASKHLDKLPRATGALSTRKTQMATGAAPAKKKVVQPTPTPASFPHLTTQRRQRLKASDFKSEPRWDFEEEYSLDGGSLQTLPWFLKITVSHSPWVQNIFLPNITLFLDSGRFNQSEWYRLEHFTPPFGFMELNQSLVQKVVSRFPPVPQQQLLLASLPTRNLTCITCAVVGNGGILNNSRMGQEIDSHDYVFRLSGTVIKGYEQDVGTRTSFYGFTAFSLGQSILNLGSSRFSACAFLGKDVRYLHFLEGTRDYEWLEAMFLNRTMANTKLYWFRHRPQEAFREALDLDRYFLVHPDFLRYMKNRFLRSKTLDTAHWRLYRPTTGALLLLTALHLCDKVSAYGFITQGHERFSDHYYDTSWKRLIFYINHDFALERTVWKRLHDEGIIQLYQRP

SEQ ID NO: 67 - protein, 567 aa, Pan troglodytes
  PEPTIDE (1)...(567): chimp alpha-N-acetylgalactosaminide alpha-2,6-sialyltransferase I (ST6GalNAc-1)
MRSCLWRCRHLSQGVQWSLLLAVLVFFLFALPSFIKEPQTKPSREPAPENNALNTQTQPKAHTAGDRGKEANQAPPEEQDKVPHTAQRAAWKSPEKEKTMVNTLSPRGQDAGMASGRTQAQSWKSQDTKTTQGNGGQTRKLMASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGVLIKGYEQDAVDRTSFYGFTAFSLTQSLLILGNRGFKNVPLGKDVRYLHFLEGTRDYEWLEALLMNQTVMSKNLFWFRHRPQEAFREALHMDRYLLLHPDFLRYMKNRFLRSKTLDGAHWRIYRPTTGALLLLTALQLCDQVSAYGFITEGHERFSDHYYDTSWKRLIFYTNHDFKLEREVWKRLHDEGIIRLYQRPGPGTAKAKN

SEQ ID NO: 68 - protein, 662 aa, Bos taurus
  PEPTIDE (1)...(662): cow alpha-N-acetylgalactosaminide alpha-2,6-sialyltransferase I (ST6GalNAc-1)
MATCPACGRLRSLLRPGSRKNEHQQNIKERSPELLQNATSQAPTPRRRATTHVESVQGTRTRDTHPKATTLTADQRRRVQTSKARAEEPGRVPTPIGKAAPQTQASKDTRADTLPPMAGGGGVASSRTEAPSLNSQNPRMTKGSGDRKARPTGPRAVPTKLRDSPSPATQRSQKLKATNFKSEPQWDFEEEYSLEVGGLQTGTRTRDTHPKATTLTADQRRRVQTSKARAEEPGRVPTPIGKAAPQTQASKDTRADTLPPMAGGGGVASSRTEAPSLNSQNPRMTKGSGDRKDRAQPTRSSAPLQSPATQRSQKLKATNFKSEPQWDFEDEYSLEVGGLQTTCPDSVKIKASKSPWLRTLFLPNLTLFLDSGHFNQSEWDRLEHFAPPFGFMELNFSLVQKVVARFPPVPQQQLLLASLPAGSSRCISCAVVGNGGILNNSHVGPEIDSHDYVFRLSGAIIKGYEHDVGTRTSFYGFTAFSLTQSLLILGSRGFPHAPLGQDVRYLHFLEGTRDYEWLEALLLNRTLTSRNLSWFRRRPQEAFQEALQLDRYLLLHPDLLRYMKNRFLRSKTLNTAHWRIYRPTTGALLLLTALQLCDQVSAYGFITEGHERFSDHYYDKSWKRTIFYTNHDFKLERALWKRLHDEGIIRLYQRPITSKPTI

SEQ ID NO: 69 - protein, 1018 aa, Canis familiaris
  PEPTIDE (1)...(1018): dog alpha-N-acetylgalactosaminide alpha-2,6-sialyltransferase I (ST6GalNAc-1)
MKIRLCRLSHLDQTTQWFLLSAVLTFFVFILPSFVKEPNTKPFRHQHIRNEERSPESLHEVTGQAPTAGDRTMAPAVASAQEKSVWAPQALATAYAAQEDTRAEALEATSAQPTSMRGQERKDTMPDTLPPRAQDKGVASDRTGLPSVMSQDTRTIKGRRDQKEEPTATRKVTPGPQSKARTTRRTPVPESQAKALTTPGAGPMGRTRKGATTAAAPHRDTARATPPSTSSQGRTTRRSPSLRAANFKSEPRWDFEEQYSFDTEALQPTCPDSVKVKASKSPWLQNLFLANLTLFLDSSRFSQREWDRLEHFAPPFGFMELNQSLVQKGVTRFPPVPQQQLLRASLPAGSSQCITCAVVGNGGILNDSRVGQEIDGHDHVFRLSGAVTKGYEQDVGTRTSFYGFTAFSITQSLLALGGRGFPHVPLGKDVRYLHFLEGTRDYEWLEALLLNQTLVKSSLSWFRRRPQEAFRDTLQLDRYLLLHPDFMRYMKNRFLRSKTLNNIHWRIYRPTTGALLLLTALHLCDQVSAYGFITEGHERFSDHYYDKSWKRTIFYTNHDFPLERTLWKRLHDEGIIRLYQRPIISKPKMVQTRPQAPPDSPGDTGTKEENPHCRRPLDLAIQRHPHFRALFDLSTPVLLSGSLFTQELWDSLSQHKAPYGWQGLSHQAINSTLSLLNGSESSQLFATSRKPLSSCIRCAVVGNGGILNGSRQGLNIDAHDYVFRQTLKTERGGRVPARRGPPGRMSPEVRRCGDGLDGDSGGRGQHSYPFPDGNVSVQGHPAAKIIKVQPPLTTPALGLPPPSLSCLPDDLRYIFIPSDIRDYVMLRSAILGVPVPEGPDKGDRSPSHSPATSASYIGPVRGIPSYIAPYVPRFLKEPPFFQPPTVLVGGKPHVVPTVLAATFYTPFFRYYAQPWPYRPHRKRPSLSGARSSRGLVWVEPNLIWDNPYKGPGSRLDLELGLYPVSAYGFITSNYWKFSDHYFERVKKPLIFYVNHDLSLEASLWRDLHKAGILQLYQR

SEQ ID NO: 70 - protein, 523 aa, Danio rerio
  PEPTIDE (1)...(523): zebrafish alpha-N-acetylgalactosaminide alpha-2,6-sialyltransferase I (ST6GalNAc-1)
MDYFLWPSVLFTLLAGIVAAFVLVKNKPAHHQSSVVVEEEKKADAGVSSQEQHCEHWDESCQLKTVEKRLQTEDKTLEKAKDLNRDDLEEDALVQPTAREEEPGIRSALREYAFSPDAESKPLKYMAGMLRTCQLEKMMTKEELEEEQSKTIIISSLILSPLGNTNLFKTQKHLNVERKVNITPIPVLYKKNFTKLPVWDFEDVYLRDSNARKPTCPKSLHNTEDPEFKESVLPDIQLWLYKGQLNMSEWNRLAHFNNPFGFMEYNYNEIKRAVDLIPKPRSSILLPVPKGSKDGCIRCAVVGAGGILNNSKMGREIDSHDYVFRVNGAVTKGYEEDVGNRTSVYVHTAFSLYATILTLKKYGFHNIPQDEGIKYVMIPEGLRDFEWLQGLLQGKAANGSFKGVRPLNFFNGHFNESRFNVLHPDFLRYIRNRFMPSKQMQGNYWAMYRPTNGAFALFLAIHTCDMVNAYGFITEDHHKYSNYYYEKFKKTSVIFYINHDYGLEIKTWKKLHDSGIIRLFQRH

SEQ ID NO: 71 - protein, 427 aa, Danio rerio
  PEPTIDE (1)...(427): zebrafish 2 alpha-N-acetylgalactosaminide alpha-2,6-sialyltransferase I (ST6GalNAc-1)
MFLLRIFLVTTFIASLPLFIFVTFYNGTSTLQIKWRQYYYWLNQGQVAGSLLTIVEPEPTNSSALTDILANTTTMRLDPFETLSTPLPIMDKHKFTSLPHWKFDDLYRLDPHFKPSECATSLQNSSNPTFKKKFIPNIQLFLQSDHLNMSEWNRLYHFNNPFGYMGLNYTAIKAAVETIHKPASSQLLQVHPGVKDGCIRCAVVGASGILNGSKLGKEIDSSDYVFRMNAAIIAGHEEDVGKRTSVYVHTAHSIIQSLMIHKKRGFKQIPTDKDIKYVLIPEGPRDYNFLESLMKNRKIPSGAYRGRTPRKYYSGHFNESSYYILHPDFLRYVRNRFLRAKQLKTKRWWVVRPTNGAFTLLLAMHTCDIVRVYGFCTADYRKYPSYYYDTKHTKLVFYGNHDYRLEMKTWKKFHDDKLIWMYLGKSN

SEQ ID NO: 72 - protein, 388 aa, Xenopus sp.
  PEPTIDE (1)...(388): Xenopus alpha-N-acetylgalactosaminide alpha-2,6-sialyltransferase I (ST6GalNAc-1)
MRPRWLRAVGITIGALTVCSLFYGHYYSSLVSVARSPQGGVGYDLPSKGLEWIPAVPHGRERNRELAETLRVQRPSKVPGTCPTSLQLRVKNDSYFKTIFNFEVPLLLWNSHLTENNWDTLSKRPVPYGWKDLPREDVASALKLLNDSANKAMFERQGPQKCIRCAVVGNGGILNGSKKGKEIDGHDYVFRLNGAVIKGFEKDVGTKTSFYGFTVNTMKNSLISYQEHGFTETPKGKDLHYIFIPSDLRDYVMLRSGILGVKVPSGYDEGDKPSEYFGPKPSPKKFKMLHPDFLLYTRDRFLKSDILNTEYASLYMPSTGGLMLLTALHSCDQVSAYGFITPDYNRYSDHYYERQKVPLEVDANHDMLMEMQLWGRLHDRGIIKLYKR

SEQ ID NO: 73 - protein, 411 aa, Takifugu rubripes
  PEPTIDE (1)...(411): Takifugu alpha-N-acetylgalactosaminide alpha-2,6-sialyltransferase I (ST6GalNAc-1) (truncated)
SSGSLESMKLSDQQIKVDSRTTATPAYVKSSGPRQHTEHRAREQEIQNVSRSTPRSRGANQTRIEVPVKKPQQPTQETRTTDPPFIGDTYMSEEIPPQTTCPDGIRTRRTNTEFSGNFLNNVPVLQWARHATHEEYGRLSQHRGAHGWGGVDYNTLVDALSVLNSSANWQMLDDWKDRSNNSECIRCAVVGNGGILKDSKRGAEIDSHHYVFRTNGAVIKGFEKDVGSRTTHYTFSATTLMNSIRAYAGVGFKAPPVSKETRYIFLPENDRDYLLVKAAATHTLVERGPQRNQKPASFFGKDVSAEKVKMYHPDFVRYLRNRFLRSATLKTKYKDIYRPSTGAVMLLVALHTCDKVSAYGFMTPDYMKYSDHYYDKKQKSVVFFKNHDLRMEMALWQRLHQAGLIQLYMRQ

SEQ ID NO: 74 - protein, 454 aa, Strongylocentrotus purpuratus
  PEPTIDE (1)...(454): sea urchin alpha-N-acetylgalactosaminide alpha-2,6-sialyltransferase I (ST6GalNAc-1)
MRLWRKLTSCKTRSRFVLLAFWYTMIALSVSLLYSLRGTHHSQDDSGTTSRRSRFYNSLFPFSRNDVADYATLTQHDVADDIVAPPHVGATGEIGPEKNVAIDDNKQIQHLIRRNSGGIAGQSGNLIGDMLNDEEQRTFEVVEEEVAEQEEIEVVNEFRDLNGKRPSGDDPRAPVTSTIDVTSIHFVNATVKPTPPPEVQGYYNVQTKDKLRMRCSQCALVSSSGHLVNTSAGAEIDSYPCVLRMNSAPVRGYEVDVGRRTTIRIMGHVNLKVLNASNELQDEILINSTTRAEKIIVPWLYNVKVNQATDMYYKSARNLSSLYPHVEFYLLTPDKMKIAESLFQTETGLTRQETRTWLSTGWMNMLYAVDVCDKVDIFGLVPENYCLKNPNSSVLYHYYESDGLKECDYYTISEERLTSGHKFITEKAVFARWATKFNMVIPPTSLEPHGRCPY

SEQ ID NO: 75 - protein, 565 aa, Artificial Sequence
  truncated human alpha-N-acetylgalactosaminide alpha-2,6-sialyltransferase I (ST6GalNAc-1 delta35)
KEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRYLLLHPDFLRYMKNRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 76 - protein, 958 aa, Artificial Sequence [sequence omitted]

SEQ ID NO: 77 - protein, 335 aa, Artificial Sequence
  truncated chicken N-acetylgalactosamine-alpha-2,6-sialyltransferase I (ST6GalNAc-1 delta231)
KTEPQWDFDDEYILDSSSPVSTCSESVRAKAAKSDWLRDLFLPNITLFIDKSYFNVSEWDRLEHFAPPYGFMELNYSLVEEVMSRLPPNPHQQLLLANSSSNVSTCISCAVVGNGGILNNSGMGQEIDSHDYVFRVSGAVIKGYEKDVGTKTSFYGFTAYSLVSSLQNLGHKGFKKIPQGKHIRYIHFLEAVRDYEWLKALLLDKDIRKGFLNYYGRRPRERFDEDFTMNKYLVAHPDFLRYLKNRFLKSKNLQKPYWRLYRPTTGALLLLTALHLCDRVSAYGYITEGHQKYSDHYYDKEWKRLVFYVNHDFNLEKQVWKRLHDENIMKLYQRS

SEQ ID NO: 78 - protein, 406 aa, Homo sapiens
  PEPTIDE (1)...(406): human beta-galactoside alpha-2,6-sialyltransferase (ST6Gal I)
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 79 - protein, 403 aa, Mus musculus
  PEPTIDE (1)...(403): mouse beta-galactoside alpha-2,6-sialyltransferase (ST6Gal I)
MIHTNLKRKFSCFVLVFLLFAIICVWKKGSDYEALTLQAKVFQMPKSQEKVAVGPAPQAVFSNSKQDPKEGVQILSYPRVTAKVKPQPSLQVWDKDSTYSKLNPRLLKIWRNYLNMNKYKVSYKGPGPGVRFSVEGLRCHLRDHVNVSMIEATDSPFNTTEWEGYLPKETFRTKAGPCTKCAVVSSAGSLKNSQLGREIDNHDAVLRFNGAPTDNFQQDVGTKTTIRLVNSQLVTTEKRFLKDSLYTEGILILWDPSVYHADIPQWYQKPDYNFFETYKSYRRLHPSQPFYILKPQMPWELWDIIQEISPDLIQPNPPSSGMLGIIIMMTLCDQVDIYEFLPSKRKTDVCYYHQKFFDSACTMGAYHPLLFEKNMVKHLNEGTDEDIYLFGKATLSGFRNNRC

SEQ ID NO: 80 - protein, 403 aa, Rattus norvegicus
  PEPTIDE (1)...(403): rat beta-galactoside alpha-2,6-sialyltransferase (ST6Gal I)
MIHTNLKKKFSLFILVFLLFAVICVWKKGSDYEALTLQAKEFQMPKSQEKVAMGSASQVVFSNSKQDPKEDIPILSYHRVTAKVKPQPSFQVWDKDSTYSKLNPRLLKIWRNYLNMNKYKVSYKGPGPGVKFSVEALRCHLRDHVNVSMIEATDFPFNTTEWEGYLPKENFRTKVGPWQRCAVVSSAGSLKNSQLGREIDNHDAVLRFNGAPTDNFQQDVGSKTTIRLMNSQLVTTEKRFLKDSLYTEGILIVWDPSVYHADIPKWYQKPDYNFFETYKSYRRLNPSQPFYILKPQMPWELWDIIQEISADLIQPNPPSSGMLGIIIMMTLCDQVDIYEFLPSKRKTDVCYYHQKFFDSACTMGAYDPLLFEKNMVKHLNEGTDEDIYLFGKATLSGFRNIRC

SEQ ID NO: 81 - protein, 405 aa, Bos taurus
  PEPTIDE (1)...(405): cow beta-galactoside alpha-2,6-sialyltransferase (ST6Gal I)
MTRTSLKKKVFSCCVLIFLLFAIICVWKEKKKGNYYEFLKLQNKEYQVLQGLEKLAVSSSSQPVSSSSTHNPQRNIQALGGPKAKLKATFQVWDKDSSSKNLAPRLQTIRKNYLNMNKYKVTYKGPGPGVKFSAEALLCHLRDHVNISMIEASDFPFNTSDWEGYLPQEDIRSKAGPWGRCAVVSSAGSLKSSRLGREIDDHDAVLRFNGAPTVKFQQDVGTKTTIRLVNSQLVTTEAGFLKDSLYNEGILIVWDPSVYHSDIPKWYRNPDYSFFNNFKSYRKLHPDQPFYILKPQMPWELWDIIQEISSELIQPNPPSSGMLGIAIMMSLCDQVDIYEFLPSKRKTDVCYYYQRYFDSACTMGAYHPLLFEKNMVKYLNLGTDEDIYLLGKATLPGFRTIRCGA

SEQ ID NO: 82 - protein, 413 aa, Gallus gallus
  PEPTIDE (1)...(413): chicken beta-galactoside alpha-2,6-sialyltransferase (ST6Gal I)
MVHINVLKKFMCVLVVILIALTVCLWKETRGSYYVPLKNDGTQVHRALDKWNLLKSQGLLHEAAGEMGQMPKALPNNQNKVKGITSGAVEKSRKAAEHVKVWDKDSSSRNLIPRLQKVRKNYLSMNKYNVTYNGKMNAAKLSPEQLLCRLRDRVNVTMIRGSDGPFNSSEWQHYLPDKSLNETVGRLGRCAVVSSAGSLKSSHLGPEIDSHDAVLRFNGAPVKGFQEDVGQKTTIRLVNSQLVTVEEQQFLKDALYNTGILIVWDPAPYHAEIHEWYRKPDYKFFEAYKSYRIRHPEQPFYILNPKMQWQLWDILQENSLEHIQPNPPSSGMLGIVIMMTLCDEVDVYEFLPSKRQTDICHYYQKFHDHACTMGAYHPLLFEKNLVKHLNQGTDEDIYTHGKVTLPGFRNVHC

SEQ ID NO: 83 - protein, 356 aa, Homo sapiens
  PEPTIDE (1)...(356): human alpha-N-acetylneuraminide alpha-2,8-sialyltransferase (ST8Sia I)
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 84 - protein, 356 aa, Rattus norvegicus
  PEPTIDE (1)...(356): rat alpha-N-acetylneuraminide alpha-2,8-sialyltransferase (ST8Sia I)
MSPGGGPLHTSRGAMAMLARKFPRTRLPVGASALCVVVLCWLYVFPVYRLPNEKEIVQGVLAQRTAWRRNQTSARLFRKQMEDCCNPAHLFAMTKVNSPMGKSLWYDGEFLYSLTIDTSTYSLFPQATPFQLPLKKCAVVGNGGILKMSGCGRQIDEANFVMRCNLPPLSSEYTRDVGSKTQLVTANPSIIRQRFENLLWSRKKFVDNMKIYNHSYIYMPAFSMKTGTEPSLRVYYTLKDAGANQTVLFANPNFLRNIGKFWKGRGIHAKRLSTGLFLVSAALGLCEEVSIYGFWPFSVNMQGEPISHHYYDNVLPFSGFHAMPEEFLQLWYLHKMGALRMQLDPCENPPSPQPTS

SEQ ID NO: 85 - protein, 356 aa, Bos taurus
  PEPTIDE (1)...(356): cow alpha-N-acetylneuraminide alpha-2,8-sialyltransferase (ST8Sia I)
MSPCGRARRHTSRGAMAVLAWKFPRTRLPVGASALCVVVLCWLYVFPVYRLPDEKEIVQGVLQQGTAWRRNRTAAGIFRKQMEDCCDPAHLFAMTKMNAPMGKSLWYDGEFLYSFTIDNSTYSLFPQATPFQLPLKKCAVVGNGGILKKSGCGRQIDEADFVMRCNLPPLSSEYTKDVGSKSHLVTANPSIIRQRFQNLLWSRKTFVDHMKVYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDNSLQPTS

SEQ ID NO: 86 - protein, 375 aa, Homo sapiens
  PEPTIDE (1)...(375): human alpha-2,8-sialyltransferase 8B (ST8Sia II, PSA-T, SIAT8B)
MQLQFRSWMLAALTLLVVFLIFADISEIEEEIGNSGGRGTIRSAVNSLHSKSNRAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 87 - protein, 375 aa, Xenopus sp.
  PEPTIDE (1)...(375): Xenopus alpha-2,8-sialyltransferase 8B (ST8Sia II)
MNPDFRSWVLATVTLLVVFLILADISELEEEIGSTGGSGTIRSAAGNVHSKSNRAELILNNSSTSSTAGRSNESIKYRTKPVPYIWRHNQTLALKIRKQILHFLDAERDISVLKGTLKPGDIIHYVFDRDSTMNISKNLYELLPRTSPLKNKHFKTCAIVGNSGILLNSGCGKEIDSHDFVIRCNLAPVEEYAKDVGTKTNLVTMNPSVVQRAFEDLVNDTWKDKFLQRLKSLNESILWIPAFMAKGGEERVEWVNDLIIKHHINVHTAYPSLRLLHAVRGYWLTNKVHIKRPTTGILMYTLATRFCNRIYLYGFWPFPRDLHQNPVKYHYYDSLKYGYTSQAGPHAMPLEFKALKNLHLQGALKLNVGECEAAT

SEQ ID NO: 88 - protein, 375 aa, Rattus norvegicus
  PEPTIDE (1)...(375): rat alpha-2,8-sialyltransferase 8B (ST8Sia II)
MQLQFRSWMLAALTLLVVFLIFADISEIEEEIGNSGGRGTIRSAVNSLHSKSNRAEVVINGSSLPAVADRSNESLKHSIQPASSKWRHNQTLSLRIRKQILKFLDAEKDISVLKGTLKPGDIIHYIFDRDSTMNVSQNLYELLPRTSPLKNKHFQTCAIVGNSGVLLNSGCGQEIDTHSFVIRCNLAPVQEYARDVGLKTDLVTMNPSVIQRAFEDLVNATWREKLLQRLHGLNGSILWIPAFMARGGKERVEWVNALILKHHVNVRTAYPSLRLLHAVRGYWLTNKVHIKRPTTGLLMYTLATRFCNQIYLYGFWPFPLDQNQNPVKYHYYDSLKYGYTSQASPHTMPLEFKALKSLHEQGALKLTVGQCDGAT

SEQ ID NO: 89 - protein, 375 aa, Gallus gallus
  PEPTIDE (1)...(375): chicken alpha-2,8-sialyltransferase 8B (ST8Sia II)
MPLPCRGWTLALLTLLVGFLIFADISEIEGENGSSGGRGTIRSAVNSLHSKSNRAEVVINDSSSPAVVDRSNESIKHNIKPASSKWRHNQTLSLKIRKQILKFLDAEKDISVLKGTLKPGDVIHYVFDRDSTMNVSQNLYELLPRTSPLKGKQFPSCAIVGNSGVLLGSGCGPEIDTHSFVIRCNLAPVQEYSQDVGTKTDLVTMNPSVIQRAFEDLMNETWREKLLQRLHSLNGSILWIPAFMAKGGKERVEWVNELILKHRINVRTAYPSLRLLHAVRGYWLTNKVHIKRPTTGLLMYTLATRFCNRIHLYGFWPFPLDQNQQPVKYHYYDSLKYGYTSQASPHTMPLEFKALKTLHQQGALKLTVGECEGDT

SEQ ID NO: 90 - protein, 380 aa, Homo sapiens
  PEPTIDE (1)...(380): human alpha-2,8-sialyltransferase 8C (ST8Sia III)
MRNCKMARVASVLGLVMLSVALLILSLISYVSLKKENIFTTPKYASPGAPRMYMFHAGFRSQFALKFLDPSFVPITNSLTQELQEKPSKWKFNRTAFLHQRQEILQHVDVIKNFSLTKNSVRIGQLMHYDYSSHKYVFSISNNFRSLLPDVSPIMNKHYNICAVVGNSGILTFIQCGREIDKSDFVFRCNFAPSEAFQRDVGRKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGILMYTLASAICEEIHLYGFWPFGFDPNTREDLPYHYYDKKGTKFTTKWQESHQLPAEFQLLYRMHGEGLTKLTLSHCA

SEQ ID NO: 91 - protein, 380 aa, Rattus norvegicus
  PEPTIDE (1)...(380): rat alpha-2,8-sialyltransferase 8C (ST8Sia III)
MRNCKMARVASILGLVMLSVALLILSLISYVSLKKENIFTTPKYASPGAPRMYMFHAGFRSQFALKFLEPSFVPITNFLTHELQEKPSKWTFNRTAFLHQRQEILQHVDVIKNFSLTKNSVRIGQLIHYDYSSHKYVFSISNNFRSLLPDVSPILNKRYNICAVVGNSGILTGSQCGQEIDKSDFVFRCNFAPTEAFHKDVGKKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGFLMYTLASAICEEIHLYGFWPFGFDPNTREDLPYHYYDKKGTKFTTKWQESHQLPAEFQLLYRMHGEGLTKLTLSHCA

SEQ ID NO: 92 - protein, 375 aa, Gallus gallus
  PEPTIDE (1)...(375): chicken alpha-2,8-sialyltransferase 8C (ST8Sia III)
MVRVASVLGLVMLSIALLILSLISYVSLKKDNIFGAPRAAGPGGPRMYMFHAGFRSQFALKFLDPSFVPITNSLGQELQEKPSKWVFNRTAFAQQRQEILQHVDVIKNFSLTKNSVRIGQLMHYDYSSHKYVFSISNNFRSLLPDVSPILNKHYNVCAVVGNSGILTGSQCGQEIDKSDFVFRCNFAPTEAFQKDVGRKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGILMYTLASAICEEIHLYGFWPFGFDPNTREDLPYHYYDKKGTKFTTKWQESHQLPAEFQLLYRMHGEGLAKLTLSRCA

SEQ ID NO: 93 - protein, 380 aa, Mus musculus
  PEPTIDE (1)...(380): mouse alpha-2,8-sialyltransferase 8C (ST8Sia III)
MRNCKMARVASVLGLVMLSVALLILSLISYVSLKKENIFTTPKYASPGAPRMYMFHAGFRSQFALKFLDQSFVPITNSLTHELQEKPSKWTFNRTAFLHQRQEILQHVDVIKNFSLTKSSVRIGQLMHYDYSSHKYVFSISNNFRSLLPDVSPIMNKRYNVCAVVGNSGILTGSQCGQEIDKSDFVSRCNFAPTEAFHKDVGRKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGILMYTLASAICEEIHLYGFWPFGFDPNTREDLPYHYYDKKGTKFTTKWQESHQLPAEFQLLYRMHGEGLTKLTLSHCA

SEQ ID NO: 94 - protein, 359 aa, Homo sapiens
  PEPTIDE (1)...(359): human alpha-2,8-sialyltransferase 8D (ST8Sia IV)
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCVKQ

SEQ ID NO: 95 - protein, 353 aa, Rattus norvegicus
  PEPTIDE (1)...(353): rat alpha-2,8-sialyltransferase 8D (ST8Sia IV)
MRSIRKRWTICTISLLLIFYKTKEIARTEEHQETQLIGDGELCLSRSLVNNSDKITRKAGSTIFQHSVQGWKINSSLVLEIRKNILRFLDAERDVSVVKSSFKPGDVIHYVLDRRRTLNISHDLHSLLPEVSPMKNRRFKTCAVVGNSGILLDSGCGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPITGLLMYTLATRFCDEIHLYGFWPFPKDLNGKAVKYHYYDDLKYRYFSNASPHRMPLEFKTLNVLHNRGALKLTT

SEQ ID NO: 96 - protein, 359 aa, Gallus gallus
  PEPTIDE (1)...(359): chicken alpha-2,8-sialyltransferase 8D (ST8Sia IV)
MRSVRKRWTVCTISLLLIFYKTKEIARTEERQEAPLAGDGELSLSRSMINSSDKIIRKGGSAIFQHSVEGWKINSTLVLEIRKSILRFLDAERDVSVVKSSFKPGDVIHYVLDRRRTLNISQDLHSLLPEVSPMKNRRFKTCAVVGNSGILLDSGCGKEIDTHDFVIRCNLAPVVEFAADVGNKSDFITMNPSVVQRAFGGFRNESDREKFGHRLSMLNDSVLWIPAFMVKGGEKHLEWVNALILKNKLKVRTAYPSLRLIHAVRGYWLTNKVHIKRPSTGLLMYTLATRFCDEIHLYGFWPFPKDLHGKPVKYHYYDDLKYRYFSNASPHRMPLEFKTLYVLHNRGALKLTTGKCVKQ

SEQ ID NO: 97 - protein, 359 aa, Bos taurus
  PEPTIDE (1)...(359): cow alpha-2,8-sialyltransferase 8D (ST8Sia IV)
MRSIRKRWTICTISLLLIFYKTKEMARTEEHQETQLIGDGELSLSRSLVNSSDKIIRKAGSSIFQHSVEGGKINSSLVLEIRKNILRFLDAERDVSVVKSSFKPGDVIHYVLDRRRTLNISQDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCIKQ

SEQ ID NO: 98 - protein, 365 aa, Homo sapiens
  PEPTIDE (1)...(365): human alpha-1,2-fucosyltransferase (FUT1)
MWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 99 - protein, 343 aa, Homo sapiens
  PEPTIDE (1)...(343): human alpha-1,2-fucosyltransferase (FUT2)
MLVVQMPFSFPMAHFILFVFTVSTIFHVQQRLAKIQAMWELPVQIPVLASTSKALGPSQLRGMWTINAIGRLGNQMGEYATLYALAKMNGRPAFIPAQMHSTLAPIFRITLPVLHSATASRIPWQNYHLNDWMEEEYRHIPGEYVRFTGYPCSWTFYHHLRQEILQEFTLHDHVREEAQKFLRGLQVNGSRPGTFVGVHVRRGDYVHVMPKVWKGVVADRRYLQQALDWFRARYSSLIFVVTSNGMAWCRENIDTSHGDVVFAGDGIEGSPAKDFALLTQCNHTIMTIGTFGIWAAYLTGGDTIYLANYTLPDSPFLKIFKPEAAFLPEWTGIAADLSPLLKH

SEQ ID NO: 100 - protein, 365 aa, Sus scrofa
  PEPTIDE (1)...(365): pig alpha-1,2-fucosyltransferase (FUT1)
MWVPSRRHLCLTFLLVCVLAAIFFLNVYQDLFYSGLDLLALCPDHNVVSSPVAIFCLAGTPVHPNASDSCPKHPASLSGTWTIYPDGRFGNQMGQYATLLALAQLNGRQAFIQPAMHAVLAPVFRITLPVLAPEVDRHAPWRELELHDWMSEDYAHLKEPWLKLTGFPCSWTFFHHLREQIRSEFTLHDHLRQEAQGVLSQFRLPRTGDRPSTFVGVHVRRGDYLRVMPKRWKGVVGDGAYLQQAMDWFRARYEAPVFVVTSNGMEWCRKNIDTSRGDVIFAGDGREAAPARDFALLVQCNHTIMTIGTFGFWAAYLAGGDTIYLANFTLPTSSFLKIFKPEAAFLPEWVGINADLSPLQMLAGP

SEQ ID NO: 101 - protein, 340 aa, Sus scrofa
  PEPTIDE (1)...(340): pig alpha-1,2-fucosyltransferase (FUT2)
MLSMQASFFFPTGPFILFVFTASTIFHLQQRMVKIQPTWELQMVTQVTTESPSSPQLKGMWTINAIGRLGNQMGEYATLYALARMNGRPAFIPPEMHSTLAPIFRITLPVLHASTARRIPWQNYHLNDWMEERYRHIPGEYVRLTGYPCSWTFYHHLRTEILREFTLHNHVREEAQDFLRGLRVNGSRPSTYVGVHVRRGDYVHVMPNVWKGVVADRRYLEQALDWFRARYRSPVFVVSSNGMAWCRENINASRGDVVFAGNGIEGSPAKDFALLTQCNHTVMTIGTFGIWAAYLAGGETIYLANYTLPDSPFLKLFKPEAAFLPEWIGIEADLSPLLKH

SEQ ID NO: 102 - protein, 376 aa, Rattus norvegicus
  PEPTIDE (1)...(376): rat alpha-1,2-fucosyltransferase (FUT1)
MWTPSRKQLCLAFLSVCVLSAGSFFFHLNGGNFFQNALTFSVLCPDYHLLKSPVAMVCLPYPSNASSGSPSCPEQSLLSGTWTITPGGRFGNQMGQYATLLALAQLNGRRAFIQPEMHTTLAPVFRISLPVLDPEVDSLTPWQHLVLHDWMSEEYSHLEDPFLKLSGFPCSWTFFHHLREQIRREFTLHDHLREDAQRLLSGLRIGPAGIRPRTYVGVHVRRGDYLEVMPNRWKGVVGDRAYLQKAMDWFRARHKDPIFVVTSNGMRWCLENIDTSHGDVVFAGNGQEGTPGKDFALLTQCNHTIMTIGTFGFWAAYLAGGDTVYLANFTLPDSEFLKIFRPKAAFLPEWVGINADLSPLQAQFDPWETDSLFRLA

SEQ ID NO: 103 - protein, 380 aa, Rattus norvegicus
  PEPTIDE (1)...(380): rat alpha-1,2-fucosyltransferase (FUT2)
MASAQVPFSFPLAHFLIFVFVTSTIIHLQQRIVKLQPLSEKELPMTTQMSSGNTESPEMRRDSEQHGNGELRGMFTINSIGRLGNQMGEYATLFALARMNGRLAFIPASMHNALAPIFRISLPVLHSDTAKKIPWQNYHLNDWMEERYRHIPGHFVRFTGYPCSWTFYHHLRPEILKEFTLHDHVREEAQAFLRGLRVNGSQPSTFVGVHVRRGDYVHVMPNVWKGVVADRGYLEKALDMFRARYSSPVFVVTSNGMAWCRENINASRGDVVFAGNGIEGSPAKDFALLTQCNHTIMTIGTFGIWAAYLAGGDTIYLANYTLPDSPFLKVFKPEAAFLPEWVGIPADLSPLLKALTPACPRSHFHLKAKGVTCYVAGRAF

SEQ ID NO: 104 - protein, 361 aa, Homo sapiens
  PEPTIDE (1)...(361): human fucosyltransferase (FUT3)
MDPLGAAKPQWPWRRCLAALLFQLLVAVCFFSYLRVSRDDATGSPRAPSGSSRQDTTPTRPTLLILLWTWPFHIPVALSRCSEMVPGTADCHITADRKVYPQADTVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 105 - protein, 359 aa, Homo sapiens
  PEPTIDE (1)...(359): human fucosyltransferase (FUT6/FCT3A)
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQEESRYQTRGIAAWFT

SEQ ID NO: 106 - protein, 374 aa, Homo sapiens
  PEPTIDE (1)...(374): human fucosyltransferase (FUT5)
MDPLGPAKPQWLWRRCLAGLLFQLLVAVCFFSYLRVSRDDATGSPRPGLMAVEPVTGAPNGSRCQDSMATPAHPTLLILLWTWPFNTPVALPRCSEMVPGAADCNITADSSVYPQADAVIVHHWDIMYNPSANLPPPTRPQGQRWIWFSMESPSNCRHLEALDGYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQQESRYQTVRSIAAWFT

SEQ ID NO: 107 - protein, 342 aa, Homo sapiens
  PEPTIDE (1)...(342): human fucosyltransferase (FUT7)
MNNAGHGPTRRLRGLGVLAGVALLAALWLLWLLGSAPRGTPAPQPTITILVWHWPFTDQPPELPSDTCTRYGIARCHLSANRSLLASADAVVFHHRELQTRRSHLPLAQRPRGQPWVWASMESPSHTHGLSHLRGIFNWVLSYRRDSDIFVPYGRLEPHWGPSPPLPAKSRVAAWVVSNFQERQLRARLYRQLAPHLRVDVFGRANGRPLCASCLVPTVAQYRFYLSFENSQHRDYITEKFWRNALVAGTVPVVLGPPRATYEAFVPADAFVHVDDFGSARELAAFLTGMNESRYQRFFAWRDRLRVRLFTDWRERFCAICDRYPHLPRSQVYEDLEGWFQA

SEQ ID NO: 108 - protein, 359 aa, Homo sapiens
  PEPTIDE (1)...(359): human fucosyltransferase (FUT9)
MTSTSKGILRPFLIVCIILGCFMACLLIYIKPTNSWIFSPMESASSVLKMKNFFSTKTDYFNETTILVWVWPFGQTFDLTSCQAMFNIQGCHLTTDRSLYNKSHAVLIHHRDISWDLTNLPQQARPPFQKWIWMNLESPTHTPQKSGIEHLFNLTLTYRRDSDIQVPYGFLTVSTNPFVFEVPSKEKLVCWVVSNWNPEHARVKYYNELSKSIEIHTYGQAFGEYVNDKNLIPTISACKFYLSFENSIHKDYITEKLYNAFLAGSVPVVLGPSRENYENYIPADSFIHVEDYNSPSELAKYLKEVDKNNKLYLSYFNWRKDFTVNLPRFWESHACLACDHVKRHQEYKSVGNLEKWFWN

SEQ ID NO: 109 - protein, 492 aa, Homo sapiens
  PEPTIDE (1)...(492): human fucosyltransferase (FUT11)
MAAGPIRVVLVLLGVLSVCAASGHGSVAEREAGGEAEWAEPWDGAVFRPPAALGAVGVTRSSGTPRPGREEAGDLPVLLWWSPGLFPHFPGDSERIECARGACVASRNRRALRDSRTRALLFYGTDFRASAAPLPRLAHQSWALLHEESPLNNFLLSHGPGIRLFNLTSTFSRHSDYPLSLQWLPGTAYLRRPVPPPMERAEWRRRGYAPLLYLQSHCDVPADRDRYVRELMRHIPVDSYGKCLQNRELPTARLQDTATATTEDPELLAFLSRYKFHLALENAICNDYMTEKLWRPMHLGAVPVYRGSPSVRDWMPNNHSVILIDDFESPQKLAEFIDFLDKNDEEYMKYLAYKQPGGITNQFLLDSLKHREWGVNDPLLPNYLNGFECFVCDYELARLDAEKAHAASPGDSPVFEPHIAQPSHMDCPVPTPGFGNVEEIPENDSWKEMWLQDYWQGLDQGEALTAMIHNNETEQTKFWDYLHEIFMKRQHL

SEQ ID NO: 110 - protein, 372 aa, Pan troglodytes
  PEPTIDE (1)...(372): chimp fucosyltransferase (FUT3)
MDPLGAAKPQWPWRRCLAALLFQLLVAVCFFSYLRVSRDDATGSPRPGLMAVEPVTGAPSGSSRQDTTPTRPTLLILLWTWPFHIPVALSRCSEMVPGAADCHITADRKVYPQADAVIVHHWDIMYNPKSRLPPSPRPQGQRWIWFNLEPPPNCQHLEALDRYFNLTMSYRSDSDIFTPYGWLEPWSGQPAHPPLNLSAKTELVAWAVSNWKLDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTMRSIAAWFT

SEQ ID NO: 111 - protein, 405 aa, Pan troglodytes
  PEPTIDE (1)...(405): chimp fucosyltransferase (FUT4)
MGAPWGSPTAAAGGRRRWRRGRGLPWTVCVLAAAGLTCTALITYACWGQLPPLPWASPTPSRPVGVLLWWEPFAGRHSAPRPPPDCRLRFNISGCRLLTDRASYGEAQAVLFHHRDLVKGPPDWPPPWGVQAHTAEEVDLRVLDYEEAAAAAEALATSSPRPPGQRWVWMNFESPSHSPGLRSLASNLFNWTLSYRADSDVFVPYGYLYPRSHPGDPPSGLAPPLSRKQGLVAWVVSHWDERQARVRYYHQLSQHVTVDVFGRGGPGQPVPEIGLLHTVARYKFYLAFENSQHLDYITEKLWRNALLAGAVPVVLGPDRANYERFVPRGAFIHVDDFPSASSLASYLLFLDRNPAVYRRYFHWRRSYAVHITSFWDEPWCRVCQAVQRAGDRPKSIRNLASWFER

SEQ ID NO: 112 - protein, 374 aa, Pan troglodytes
  PEPTIDE (1)...(374): chimp fucosyltransferase (FUT5)
MDPLGPAKPQWLWRRCLAGLLFQLLVAVCFFSYLRVSRDDATGSPRPGLMAVEPVTGAPNGSRCQDSMATPAHPTLLILLWTWPFNTPVALPRCSEMVPGAADCNITADSNVYPQADAVIVHHWDIMYNPSANLPPPTRPQGQRWIWFSMESPSNCRHLEALDGYFNLTMSYRSDSDIFTPYGWLQPWSGQPVHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 113 - protein, 359 aa, Pan troglodytes
  PEPTIDE (1)...(359): chimp fucosyltransferase (FUT6)
MDPLGPAKPQWSWRCCLTTLLFQLLVAVCFFSYLRVSRDDPTVYPNGSHFPDSTGTPAHSIPLILLWTWPFNKPIALPRCSEMVPGTADCNITADRKVYPQADAVIVHHREVMYNPSAQLPRSPRRQGQRWIWFSMESPSNCRHLEALDGYFNLTMSYRSDSDIFTPYGWLQPWSGQPVHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRFFSWALAFCKACWKLQEESRYQTRSIAAWFT

SEQ ID NO: 114 - protein, 355 aa, Canis familiaris
  PEPTIDE (1)...(355): dog fucosyltransferase (fut7)
MGPWGKPGKTASPVSHVGYSLSRRLRAVGVLAGAALLSAIWLLWLLGSPPTGGPAPPHTLIILIWHWPFSDRPPELPSNTCISFGVAHCHLSTNHSLLASADAVVFHHRELQTQQARLPLAKRPRGQPWVWVSMESPSHTHGLGRLGGIFNWVLSYRRDSDIFVPYGQLEPHQGPAPPLPAKKRVAAWVVSNFQERQRRVQVYRQLAPHLQVDVFGRANRQPLCANCLLPTVAQYLFYLSFENSQHQDYITEKFWRNALAAGTVPVVLGPPRATYEAFAPADAFVHVDDFSTAQELASFLANMNESHYRRYFAWRDRLRVRLFGDWRERFCAICTHYPHLPRGQVYQDLQGWFQA

SEQ ID NO: 115 - protein, 433 aa, Mus musculus
  PEPTIDE (1)...(433): mouse fucosyltransferase (FUT4)
MAPARQELQHESRCRPSRTVDAWRAAVATRGRHMETPGYRRRTRCGGWGLPRSVSSLAAVGLLCTALTTFICWGQLPPLPWASPAPQRLVGVLLWWEPFRGRGGYPKSPPDCSLRFNISGCRLLTDRAAYGEAQAVLFHHRDLVKELHDWPPPWGARERTDKALVLRVFDDQEGAVTLTGKALETVGSRPPGQRWVWMNFESPSHTPGLRGLAKDLFNWTLSYRTDSDVFVPYGFLYSRSDPTEQPSGLGPQLARKRGLVAWVVSNWNEHQARVRYYHQLSRHVSVDVFGRTGPGRPVPAIGLLHTVARYKFYLAFENSRHVDYITEKLWRNAFLAGAVPVVLGPDRANYERFVPRGAFIHVDDFPNAASLAAYLLFLDRNVAVYRRYFRWRRSFAVHITSFWDEQWCRTCQAVQTSGDQPKSIHNLADWFQR

SEQ ID NO: 116 - protein, 389 aa, Mus musculus
  PEPTIDE (1)...(389): mouse fucosyltransferase (FUT7)
MPTPCPPACLSTPGTHRLLPFPDWKAPSWESRKEATCNSSSPGPWAEPTVQGYHPTRRLRAWGGLAGGATFMVIWFFWLWGSAPGSAPVPQSTLTILIWHWPFTNRPPELPGDTCTRYGMASCRLSANRSLLASADAVVFHHRELQTRQSLLPLDQRPHGQPWVWASMESPSNTHGLHRFRGIFNWVLSYRRDSDIFVPYGRLEPLSGPTSPLPAKSRMAAWVISNFQERQQRAKLYRQLAPHLQVDVFGRASGRPLCANCLLPTLARYRFYLAFENSQHRDYITEKFWRNALAAGAVPVALGPPRATYEAFVPPDAFVHVDDFSSARELAVFLVSMNESRYRGFFAWRDRLRVRLLGDWRERFCTICARYPYLPRSQVYEDLESWFQA

SEQ ID NO: 117 - protein, 359 aa, Mus musculus
  PEPTIDE (1)...(359): mouse fucosyltransferase (FUT9)
MTSTSKGILRPFLIVCIILGCFMACLLIYIKPTNSWVFSPMESASSVLKMKNFFSTKTDYFNETTILVWVWPFGQTFDLTSCQAMFNIQGCHLTTDRSLYNKSHAVLIHHRDISWDLTNLPQQARPPFQKWIWMNLESPTHTPQKSGIEHLFNLTLTYRRDSDIQVPYGFLTVSTNPFVFEVPSKEKLVCWVVSNWNPEHARVKYYNELSKSIEIHTYGQAFGEYVNDKNLIPTISTCKFYLSFENSIHKDYITEKLYNAFLAGSVPVVLGPSRENYENYIPADSFIHVEDFNSPSELAKYLKEVDKNNKLYLSYFNWRKDFTVNLPRFWESHACLACDHVKRHQEYKSVGNLEKWFWN

SEQ ID NO: 118 - protein, 433 aa, Rattus norvegicus
  PEPTIDE (1)...(433): rat fucosyltransferase (FUT4)
MAPAGRKLQHESRCRPSRPVDAWRAAATTRGRCMGTPGARRTARRGGWGLPRTSSGLAAAGLLCTALTACLCWGQLPPLPWASPAPQRPVSVLLWWEPFGGRGGHSKPPPDCSLRFNISGCRLLTDRAAYGEAQAVLFHHRDLVKGPPDWPPPWGAQERTDEALELRVFDDQEGAVMLAREALETTGSRPPGQRWVWMNFESPSHTPGLRGLAKDLFNWTLSYRTDSDIFVPYGFLYPRSHPAEQPSGLGPPLARKRGLVAWVVSHWNERQARVRYYHQLRRHVSVDVFGRAGPGQPVPAVGLLHTVARYKFYLAFENSQHVDYNTEKLWRNAFLAGAVPVLLGPDRANYEGFVPRGSFIHVDDFPSAASLAAYLLFLDRNVAVYRRYFHWRRSYAVHITSFWDEPWCQTCRAVQTSGDQPKSIHNLADWFQR

SEQ ID NO: 119 - protein, 359 aa, Rattus norvegicus
  PEPTIDE (1)...(359): rat fucosyltransferase (FUT9)
MTSTSKGILRPFLIVCIILGCFVACLLIYIKPTNSWVFSPMESASSVLKMKNFFSRKTDYFNETTILVWVWPFGQTFDLTSCQAMFNIQGCHLTTDRSLYNKSHAVLIHHRDISWDLTNLPQQARPPFQKWIWMNLESPTHTPQKSGIEHLFNLTLTYRRDSDIQVPYGFLTVSTSPFVFEVPSKEKLVCWVVSNWNPEHARVKYYNELSKSIEIHTYGQAFGEYVNDKNLIPTISTCKFYLSFENSIHKDYITEKLYNAFLAGSVPVVLGPSRENYENYIPADSFIHVEDFNSPSELAKYLKEVDKNNKLYLSYFNWRKDFTVNLPRFWESHACLACDHVKRHQEYKSVGNLEKWFWN

SEQ ID NO: 120 - protein, 575 aa, Homo sapiens
  PEPTIDE (1)...(575): human fucosyltransferase (FUT8), isoform A
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 121 - protein, 169 aa, Homo sapiens
  PEPTIDE (1)...(169): human fucosyltransferase (FUT8), isoform C
MHRQIWHLHWTLVRYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 122 - protein, 575 aa, Sus scrofa
  PEPTIDE (1)...(575): pig fucosyltransferase (FUT8)
MRPWTGSWRWIMLILFAWGTLLFYIGGHLVRDNDHSDHSSRELSKILAKLERLKQQNEDLRRMAESLRIPEGPIDQGPASGRVRALEEQFMKAKEQIENYKKQTKNGPGKDHEILRRRIENGAKELWFFLQSELKKLKNLEGNELQRHADEFLSDLGHHERSIMTDLYYLSQTDGAGDWREKEAKDLTELVQRRITYLQNPKDCSKAKKLVCNINKGCGYGCQLHHVVYCFMIAYGTQRTLALESHNWRYATGGWETVFRPVSETCTDRSGSSTGHWSGEVKDKNVQVVELPIVDSVHPRPPYLPLAVPEDLADRLVRVHGDPAVWWVSQFVKYLIRPQPWLEKEIEEATKKLGFKHPVIGVHVRRTDKVGAEAAFHPIEEYTVHVEEDFQLLARRMQVDKKRVYLATDDPALLKEAKTKYPSYEFISDNSISWSAGLHNRYTENSLRGVILDIHFLSQADFLVCTFSSQVCRVAYEIMQALHPDASANFRSLDDIYYFGGPNAHNQIAIYPHQPRTEGEIPMEPGDIIGVAGNHWDGYPKGVNRKLGRTGLYPSYKVREKIETVKYPTYPEADK

SEQ ID NO: 123 - protein, 575 aa, Canis familiaris
  PEPTIDE (1)...(575): dog fucosyltransferase (fut8)
MRPWTGSWRWIMLILFAWGTLLFYIGGHLVRDNDHPDHSSRELSKILAKLERLKQQNEDLRRMAESLRIPEGPIDQAPASGRVRALEEQLLKAKEQIENYKKQTRNGLGKDHEILRRRIENGAKELWFFLQSELKKLKNLEGNVLQRHADEFLSDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVNETCTDRSGTSTGHWSGEVKDKNVQVVELPIVDSLHPRPPYLPLAVPEDLADRLVRVHGDPAVWWVSQFVKYLIRPQPWLEKEIEEATKKLGFNIPVIGVHVRRTDKVGTEAAFHPIEEYMVHVEEHFQLLARRMQVDKRRVYLATDDPSLLKEAKTKYPTYEFISDNSISWSAGLHNRYTENSLRGVILDIHFLSQADFLVCTFSSQVCRVAYEIMQTLHPDASANFHSLDDIYYFGGQNAHNQIAIYPHQPRTADEIPMEPGDIIGVAGNHWDGYSKGVNRKLGRTGLYPSYKVREKIETVKYPTYPEAEK

SEQ ID NO: 124 - protein, 575 aa, Mus musculus
  PEPTIDE (1)...(575): mouse fucosyltransferase (FUT8)
MRAWTGSWRWIMLILFAWGTLLFYIGGHLVRDNDHPDHSTRELSKILAKLERLKQQNEDLRRMAESLRIPEGPIDQGTATGRVRVLEEQLVKAKEQIENYKKQARNGLGKDHEILRRRIENGAKELWFFLQSELKKLKHLEGNELQRHADEILLDLGHHERSIMTDLYYLSQTDGAGDWREKEAKDLTELVQRRITYLQNPKDCSKARKLVCNINKGCGYGCQLHHVVYCFMIAYGTQRTLILESQNWRYATGGWETVFRPVSETCTDRSGLSTGHWSGEVNDKNIQVVELPIVDSLHPRPPYLPLAVPEDLADRLLRVHGDPAVWWVSQFVKYLIRPQPWLEKEIEEATKKLGFKHPVIGVHVRRTDKVGTEAAFHPIEEYMVHVEQHFQLLARRMQVDKKRVYLATDDPTLLKEANTKYSNYEFISDNSISWSAGLHNRYTENSLRGVILDIHFLSQADFLVCTFSSQVCRVAYEIMQTLHPDASANFHSLDDIYYFGGQNAHNQIAVYPHKPRTEEEIPMEPGDIIGVAGNHWDGYSKGINRKLGKTGLYPSYKVREKIETVKYPTYPEAEK

SEQ ID NO: 125 - protein, 575 aa, Gallus gallus
  PEPTIDE (1)...(575): chicken fucosyltransferase (fut8)
MRPWTGSWRWIMLILFAWGTLLFYIGGHLVRDSEHPDHSSRELSKILAKLERLKQQNEDLRRMAESLRIPDGPIDQGPAAGKVHALEEQLLKAKEQIENYKKQTGDGLGKDHEILRRRIENGAKELWFFLQSELKKLKNLEGSELQRRIDEFLSDLGHQERSIMTDLYYLSQTDGAGDWREKEAKDLTDLVQRRITYLQNPKDCSKAKKLVCNINKGCGYGCQLHHVVYCFMIAYGTQRTLILESQNWRYATGGWETVFRPVSETCTDRSGTTTGHWSGETNDKDVQVVELPIVDSLHPRPPYLPLAVPEDLADRLIRVHGDPAVWWVSQFVKYLIRPQPWLEKEIEEATRKLGFKHPVIGVHVRRTDKVGTEAAFHPIEEYMVHVEERFELLARRMHVDKKRVYLATDDPSLLQEAKSKYPNYEFISDNSISWSAGLHNRYTENSLRGVILDIHFLSQADFLVCTFSSQVCRVPYEIMQTLHPDASAYFHSLDDIYYFGGQNAHNQIAVYAHHPRTADEIPMEPGDIIGVAGNHWDGYSKGINRKLGKTGLYPSYKVKEKIETVKYPTYPEAEK

SEQ ID NO: 126 - protein, 559 aa, Homo sapiens
  PEPTIDE (1)...(559): human UDP-N-acetylgalactosaminyltransferase 1 (GalNAc-T1)
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 127 - protein, 559 aa, Bos taurus
  PEPTIDE (1)...(559): cow UDP-N-acetylgalactosaminyltransferase 1 (GalNAc-T1)
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMLEEIVLVDDASERDFLKRPLESYVKKLKVPVHVIRMEQRSGLIRARLKGAAVSKGQVITFLDAHCECTVGWLEPLLARIKHDRKTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRLGLRHKLQCRPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATDEDSQVPSIRDCSGSRSQQWLLRNVTLPEIF

SEQ ID NO: 128 - protein, 601 aa, Drosophila sp.
  PEPTIDE (1)...(601): Drosophila UDP-N-acetylgalactosaminyltransferase 1 (GalNAc-T1)
MLPRFRSFYGKLIIFILVALCFILYSKVQQNGSPEEPPVAPLVRAAALRGHGRERFEAYSDSENEIARPATQSPYEQIIQLDLQKQKVGLGEQGVAVHLSGAAKERGDEIYKKIALNEELSEQLTYNRSVGDHRNPLCAKQRFDSDSLPTASVVIIFFNEPYSVLLRTVHSTLSTCNEKALKEIILVDDGSDNVELGAKLDYYVRTRIPSGKVTILRLKNRLGLIRARLAGARIATGDVLIFLDAHCEGNIGWCEPLLQRIKESRTSVLVPIIDVIDANDFQYSTNGYKSFQVGGFQWNGHFDWINLPEREKQRQRRECKQEREICPAYSPTMAGGLFAIDRRYFWEVGSYDEQMDGWGGENLEMSFRIWQCGGTIETIPCSRVGHIFRDFHPYKFPNDRDTHGINTARMALVWMDEYINIFFLNRPDLKFHADIGDVTHRVMLRKKLRCKSFEWYLKNIYPEKFVPTKDVQGWGKVHAVNSNICLDDLLQNNEKPYNAGLYPCGKVLQKSQLFSFTNTNVLRNELSCATVQHSESPPYRVVMVPCMENDEFNEQWRYEHQHIIHSNTGMCLDHQGLKSLDDAQVAPCDPHSESQRWTIEH

SEQ ID NO: 129 - protein, 559 aa, Mus musculus
  PEPTIDE (1)...(559): mouse UDP-N-acetylgalactosaminyltransferase 1 (GalNAc-T1)
MRKFAYCKVVLATSLVWVLLDMFLLLYFSECNKCEEKQERGLPAGDVLELVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSRGQVITFLDAHCECTAGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRLGLRRKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCTGSRSQQWLLRNVTLPEIF

SEQ ID NO: 130 - protein, 559 aa, Sus scrofa
  PEPTIDE (1)...(559): pig UDP-N-acetylgalactosaminyltransferase 1 (GalNAc-T1)
MRKFAYCKVVLATSLIWVLLDMFLLLYFSECNKCDEKKERGLPAGDVLEPVQKPHEGPGEMGKPVVIPKEDQDKMKEMFKINQFNLMASEMIALNRSLPDVRLEGCKTKVYPDNLPTTSVVIVFHNEAWSTLLRTVHSVINRSPRHMLEEIVLVDDASERDFLKRPLESYVKKLKVPVHVIRMEQRSGLIRARLKGAAVSKGQVITFLDAHCECTVGWLEPLLARIKHDRKTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKTFFYIISPGVTKVDYGDISSRLGLRHKLQCRPFSWYLENIYPDSQIPRHYSSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCSGSRSQQWLLRNVTLPEIF

SEQ ID NO: 131 - protein, 452 aa, Xenopus sp.
  PEPTIDE (1)...(452): Xenopus UDP-N-acetylgalactosaminyltransferase 1 (GalNAc-T1)
MKKFAYCKVVLATSLVWVFLDMFLLLYFSECNKCDDKKERGLPGGDGPDINQKPHEGPGEMGKPVVIPKEEQEKMKEMFKINQFNLMASEMIALNRSLPDVRLEGCKTKVYPDSLPTTSVVIVFHNEAWTTLLRTVHSVINRSPRHLLQEIILVDDASEREFLKRPLETYVKKLTVPVHVLRMEQRSGLIRARLRGAAASKGQVITFLDAHCECTVGWLEPLLARIKHDRRTVVCPIIDVISDDTFEYMAGSDMTYGGFNWKLNFRWYPVPQREMDRRRGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISTRVGLRHKLQCKPFSWYLENVYPDSQIPRHYYSLGEVSNIIIKLCFINVILLIHI

SEQ ID NO: 132 - protein, 559 aa, Rattus norvegicus
  PEPTIDE (1)...(559): rat UDP-N-acetylgalactosaminyltransferase 1 (GalNAc-T1)
MRKFAYCKVVLATSLVWVLLDMFLLLYFSECNKCEEKKERGLPAGDVLELVQKPHEGPGEMGKPVVIPKEDQEKMKEMFKINQFNLMASEMIAFNRSLPDVRLEGCKTKVYPDSLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCTGSRSQQWLLRNVTLPEIF

SEQ ID NO: 133 - protein, 633 aa, Homo sapiens
  CHAIN (1)...(633): human UDP-N-acetylgalactosaminyltransferase 3 (GalNAc-T3)
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLRCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 134 - protein, 667 aa, Drosophila sp.
  PEPTIDE (1)...(667): Drosophila UDP-N-acetylgalactosaminyltransferase 3 (GalNAc-T3)
MGLRFQQLKKLWLLYLFLLFFAFFMFAISINLYVASIQGGDAEMRHPKPPPKRRSLWPHKNIVAHYIGKGDIFGNMTADDYNINLFQPINGEGADGRPVVVPPRDRFRMQRFFRLNSFNLLASDRIPLNRTLKDYRTPECRDKKYASGLPSTSVIIVFHNEAWSVLLRTITSVINRSPRHLLKEIILVDDASDRSYLKRQLESYVKVLAVPTRIFRMKKRSGLVPARLLGAENARGDVLTFLDAHCECSRGWLEPLLSRIKESRKVVICPVIDIISDDNFSYTKTFENHWGAFNWQLSFRWFSSDRKRQTAGNSSKDSTDPIATPGMAGGLFAIDRKYFYEMGSYDSNMRVWGGENVEMSFRIWQCGGRVEISPCSHVGHVFRSSTPYTFPGGMSEVLTDNLARAATVWMDDWQYFIMLYTSGLTLGAKDKVNVTERVALRERLQCKPFSWYLENIWPEHFFPAPDRFFGKIIWLDGETECAQAYSKHMKNLPGRALSREWKRAFEEIDSKAEELMALIDLERDKCLRPLKEDVPRSSLSAVTVGDCTSHAQSMDMFVITPKGQIMTNDNVCLTYRQQKLGVIKMLKNRNATTSNVMLAQCASDSSQLWTYDMDTQQISHRDTKLCLTLKAATNSRLQKVEKVVLSMECDFKDITQKWGFIPLPWRM

SEQ ID NO: 135 - protein, 633 aa, Mus musculus
  PEPTIDE (1)...(633): mouse UDP-N-acetylgalactosaminyltransferase 3 (GalNAc-T3)
MAHLKRLVKLHIKRHYHRKFWKLGAVIFFFLVVLILMQREVSVQYSKEESKMERNLKNKNKMLDFMLEAVNNIKDAMPKMQIGAPIKENIDVRERPCLQGYYTAAELKPVFDRPPQDSNAPGASGKPFKITHLSPEEQKEKERGETKHCFNAFASDRISLHRDLGPDTRPPECIEQKFKRCPPLPTTSVIIVFHNEAWSTLLRTVHSVLYSSPAILLKEIILVDDASVDDYLHEKLEEYIKQFSIVKIVRQQERKGLITARLLGAAVATAETLTFLDAHCECFYGWLEPLLARIAENYTAVVSPDIASIDLNTFEFNKPSPYGNNHNRGNFDWSLSFGWESLPDHEKQRRKDETYPIKTPTFAGGLFSISKKYFEHIGSYDEEMEIWGGENIEMSFRVWQCGGQLEIMPCSVVGHVFRSKSPHTFPKGTQVIARNQVRLAEVWMDEYKEIFYRRNTDAAKIVKQKSFGDLSKRFEIKKRLQCKNFTWYLNTIYPEAYVPDLNPVISGYIKSVGQPLCLDVGENNQGGKPLILYTCHGLGGNQYFEYSAQREIRHNIQKELCLHATQGVVQLKACVYKGHRTIAPGEQIWEIRKDQLLYNPLFKMCLSSNGEHPNLVPCDATDLLQKWIFSQND

SEQ ID NO: 136 - protein, 353 aa, Homo sapiens
  PEPTIDE (1)...(353): human alpha-1,4-galactosyltransferase (A4GALT, GalT a1,4)
MSKPPDLLLRLLRGAPRQRVCTLFIIGFKFTFFVSIMIYWHVVGEPKEKGQLYNLPAEIPCPTLTPPTPPSHGPTPGNIFFLETSDRTNPNFLFMCSVESAARTHPESHVLVLMKGLPGGNASLPRHLGISLLSCFPNVQMLPLDLRELFRDTPLADWYAAVQGRWEPYLLPVLSDASRIALMWKFGGIYLDTDFIVLKNLRNLTNVLGTQSRYVLNGAFLAFERRHEFMALCMRDFVDHYNGWIWGHQGPQLLTRVFKKWCSIRSLAESRACRGVTTLPPEAFYPIPWQDWKKYFEDINPEELPRLLSATYAVHVWNKKSQGTRFEATSRALLAQLHARYCPTTHEAMKMYL

SEQ ID NO: 137 - protein, 354 aa, Homo sapiens
  PEPTIDE (1)...(354): human human ABO blood group transferase A
MAEVLRTLAGKPKCHALRPMILFLIMLVLVLFGYGVLSPRSLMPGSLERGFCMAVREPDHLQRVSLPRMVYPQPKVLTPCRKDVLVVTPWLAPIVWEGTFNIDILNEQFRLQNTTIGLTVFAIKKYVAFLKLFLETAEKHFMVGHRVHYYVFTDQPAAVPRVTLGTGRQLSVLEVRAYKRWQDVSMRRMEMISDFCERRFLSEVDYLVCVDVDMEFRDHVGVEILTPLFGTLHPGFYGSSREAFTYERRPQSQAYIPKDEGDFYYLGGFFGGSVQEVQRLTRACHQAMMVDQANGIEAVWHDESHLNKYLLRHKPTKVLSPEYLWDQQLLGWPAVLRKLRFTAVPKNHQAVRNP

SEQ ID NO: 138 - protein, 326 aa, Homo sapiens
  PEPTIDE (1)...(326): human beta-1,3-galactosyltransferase 1 (B3GALT1)
MASKVSCLYVLTVVCWASALWYLSITRPTSSYTGSKPFSHLTVARKNFTFGNIRTRPINPHSFEFLINEPNKCEKNIPFLVILISTTHKEFDARQAIRETWGDENNFKGIKIATLFLLGKNADPVLNQMVEQESQIFHDIIVEDFIDSYHNLTLKTLMGMRWVATFCSKAKYVMKTDSDIFVNMDNLIYKLLKPSTKPRRRYFTGYVINGGPIRDVRSKWYMPRDLYPDSNYPPFCSGTGYIFSADVAELIYKTSLHTRLLHLEDVYVGLCLRKLGIHPFQNSGFNHWKMAYSLCRYRRVITVHQISPEEMHRIWNDMSSKKHLRC

SEQ ID NO: 139 - protein, 326 aa, Mus musculus; identical to SEQ ID NO: 138
  PEPTIDE (1)...(326): mouse beta-1,3-galactosyltransferase 1 (B3GALT1)

SEQ ID NO: 140 - protein, 397 aa, Homo sapiens
  PEPTIDE (1)...(397): human beta-1,3-N-acetylglucosaminyltransferase 1 (B3GNT1)
MSVGRRRIKLLGILMMANVFIYFIMEVSKSSSQEKNGKGEVIIPKEKFWKISTPPEAYWNREQEKLNRQYNPILSMLTNQTGEAGRLSNISHLNYCEPDLRVTSVVTGFNNLPDRFKDFLLYLRCRNYSLLIDQPDKCAKKPFLLLAIKSLTPHFARRQAIRESWGQESNAGNQTVVRVFLLGQTPPEDNHPDLSDMLKFESEKHQDILMWNYRDTFFNLSLKEVLFLRWVSTSCPDTEFVFKGDDDVFVNTHHILNYLNSLSKTKAKDLFIGDVIHNAGPHRDKKLKYYIPEVVYSGLYPPYAGGGGFLYSGHLALRLYHITDQVHLYPIDDVYTGMCLQKLGLVPEKHKGFRTFDIEEKNKNNICSYVDLMLVHSRKPQEMIDIWSQLQSAHLKC

SEQ ID NO: 141 - protein, 397 aa, Mus musculus
  PEPTIDE (1)...(397): mouse beta-1,3-N-acetylglucosaminyltransferase 1 (B3gnt1)
MSVGRRRVKLLGILMMANVFIYLIVEVSKNSSQDKNGKGGVIIPKEKFWKPPSTPRAYWNREQEKLNRWYNPILNRVANQTGELATSPNTSHLSYCEPDSTVMTAVTDFNNLPDRFKDFLLYLRCRNYSLLIDQPKKCAKKPFLLLAIKSLIPHFARRQAIRESWGRETNVGNQTVVRVFLLGKTPPEDNHPDLSDMLKFESDKHQDILMWNYRDTFFNLSLKEVLFLRWVSTSCPDAEFVFKGDDDVFVNTHHILNYLNSLSKSKAKDLFIGDVIHNAGPHRDKKLKYYIPEVFYTGVYPPYAGGGGFLYSGPLALRLYSATSRVHLYPIDDVYTGMCLQKLGLVPEKHKGFRTFDIEEKNKKNICSYIDLMLVHSRKPQEMIDIWSQLQSPNLKC

SEQ ID NO: 142 - protein, 447 aa, Homo sapiens
  PEPTIDE (1)...(447): human N-acetylglucosaminyltransferase 2 (GnT-II)
MRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHFVWERVKILRDYAGLILFLEEDHYLAPDFYHVFKKMWKLKQQECPECDVLSLGTYSASRSFYGMADKVDVKTWKSTEHNMGLALTRNAYQKLIECTDTFCTYDDYNWDWTLQYLTVSCLPKFWKVLVPQIPRIFHAGDCGMHHKKTCRPSTQSAQIESLLNNNKQYMFPETLTISEKFTVVAISPPRKNGGWGDIRDHELCKSYRRLQ

SEQ ID NO: 143 - protein, 446 aa, Sus scrofa
  PEPTIDE (1)...(446): pig N-acetylglucosaminyltransferase 2 (GnT-II)
MRFRIYKRKVLILTFVVAACGFVLWSSNGRQRKNEALAPPLLDAEPVRGAGARAGDHPAISVGIRRGSNDSAAPLVAAAPQPEVDNLTLRYRSLVYQLNFDQTLRNVDKVSSWVPRELVLVVQVHNRAEYLKLLLDSLRKAQGIDNVLVIFSHDFWSTEINQLIAGVDFCPVLQVFFPFSIQLYPNEFPGTDPRDCPRDLEKNAALKMGCINAEYPDSFGHYREAKFSQTKHHWWWKLHFVWERVKVLRDYAGLILFLEEDHYVAPDFYHVFKKMWNLKQQECPECDVLSLGTYTTVRSFRDVADKVDVKTWKSTEHNMGLALTRDAYQKLIECTDTFCTYDDYNWDWTLQYLTVSCLPKFWKVLVPQVPRIFHAGDCGMHHKKTCRPSTQSAQIESLLNSNKQYMFPETLTISEKLTAALSPPRKNGGWGDIRDHELCKSYRRLQ

SEQ ID NO: 144 - protein, 442 aa, Mus musculus
  PEPTIDE (1)...(442): mouse N-acetylglucosaminyltransferase 2 (GnT-II)
MRFRIYKRKVLILTLVVAACGFVLWSSNGRQRKSDALGPPLLDAEPVRGAGHLAVSVGIRRVSNESAAPLVPAVPRPEVDNLTLRYRSLVYQLNFDQMLRNVGNDGTWSPGELVLVVQVHNRPEYLRLLIDSLRKAQGIQEVLVIFSHDFWSAEINSLISRVDFCPVLQVFFPFSIQLYPNEFPGSDPRDCPRDLKKNAALKLGCINAEYPDSFGHYREAKFSQTKHHWWWKLHFVWERVKVLQDYTGLILFLEEDHYLAPDFYHVFKKMWKLKQQECPGCDVLSLGTYTTIRSFYGIADKVDVKTWKSTEHNMGLALTRDAYQKLIECTDTFCTYDDYNWDWTLQYLTLACLPKIWKVLVPQAPRIFHAGDCGMHHKKTCRPSTQSAQIESLLNSNKQYLFPETLVIGEKFPMAAISPPRKNGGWGDIRDHELCKSYRRLQ

SEQ ID NO: 145 - protein, 442 aa, Rattus norvegicus
  PEPTIDE (1)...(442): rat N-acetylglucosaminyltransferase 2 (GnT-II)
MRFRIYKRKVLILTLVVAACGFVLWSSNGRQRKNDALAPPLLDSEPLRGAGHFAASVGIRRVSNDSAAPLVPAVPRPEVDNLTLRYRSLVYQLNFDQMLRNVDKDGTWSPGELVLVVQVHNRPEYLRLLIDSLRKAQGIREVLVIFSHDFWSAEINSLISSVDFCPVLQVFFPFSIQLYPSEFPGSDPRDCPRDLKKNAALKLGCINAEYPDSFGHYREAKFSQTKHHWWWKLHFVWERVKVLQDYTGLILFLEEDHYLAPDFYHVFKKMWKLKQQECPGCDVLSLGTYTTIRSFYGIADKVDVKTWKSTEHNMGLALTRDAYQKLIECTDTFCTYDDYNWDWTLQYLTLACLPKVWKVLVPQAPRIFHAGDCGMHHKKTCRPSTQSAQIESLLNNNKQYLFPETLVIGEKFPMAAISPPRKNGGWGDIRDHELCKSYRRLQ

SEQ ID NO: 146 - protein, 533 aa, Homo sapiens
  PEPTIDE (1)...(533): human N-acetylglucosaminyltransferase 3 (GnT-III)
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGGRGARRKWVECVCLPGWHGPSCGVPTVVQYSNLPTKERLVPREVPRRVINAINVNHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTVDMLQAVYGLDGIRLRRRQYYTMPNFRQYENRTGHILVQWSLGSPLHFAGWHCSWCFTPEGIYFKLVSAQNGDFPRWGDYEDKRDLNYIRGLIRTGGWFDGTQQEYPPADPSEHMYAPKYLLKNYDRFHYLLDNPYQEPRSTAAGGWRHRGPEGRPPARGKLDEAEV

SEQ ID NO: 147 - protein, 538 aa, Mus musculus
  PEPTIDE (1)...(538): mouse N-acetylglucosaminyltransferase 3 (GnT-III)
MKMRRYKLFLMFCMAGLCLISFLHFFKTLSYVTFPRELASLSPNLISSFFWNNAPVTPQASPEPGDPDLLRTPLYSHSPLLQPLSPSKATEELHRVDFVLPEDTTEYFVRTKAGGVCFKPGTRMLEKPSPGRTEEKTEVSEGSSARGPARRPMRHVLSSRERLGSRGTRRKWVECVCLPGWHGPSCGVPTVVQYSNLPTKERLVPREVPRRVINAININHEFDLLDVRFHELGDVVDAFVVCDSNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTMDMLQAVYGLDGIRLRRRQYYTMPNFRQYENRTGHILVQWSLGSPLHFAGWHCSWCFTPEGIYFKLVSAQNGDFPRWGDYEDKRDLNYIRSLIRTGGWFDGTQQEYPPADPSEHMYAPKYLLKNYDQFRYLLENPYREPKSTVEGGRQNQGSDGRSSAVRGKLDTAEG

SEQ ID NO: 148 - protein, 538 aa, Rattus norvegicus
  PEPTIDE (1)...(538): rat N-acetylglucosaminyltransferase 3 (GnT-III)
MKMRRYKLFLMFCMAGLCLISFLHFFKTLSYVTFPRELASLSPNLISSFFWNNAPVTPQASPEPGDPDLLRTPLYSHSPLLQPLSPSKATEELHRVDFVLPEDTTEYFVRTKAGGVCFKPGTRMLEKPSPGRTEEKTKVAEGSSVRGPARRPMRHVLSARERLGGRGTRRKWVECVCLPGWHGPSCGVPTVVQYSNLPTKERLVPREVPRRVINAININHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTIDMLQAVYGLDGIRLRRRQYYTMPNFRQYENRTGHILVQWSLGSPLHFAGWHCSWCFTPEGIYFKLVSAQNGDFPRWGDYEDKRDLNYIRSLIRTGGWFDGTQQEYPPADPSEHMYAPKYLLKNYDQFRYLLENPYREPKSTVEGGRRNQGSDGRSSAVRGKLDTTEG

SEQ ID NO: 149 - protein, 478 aa, Mus musculus
  PEPTIDE (1)...(478): mouse N-acetylglucosaminyltransferase 4 (GnT-IV)
MLKFYQMKYIFQILDKMRCLRKRSTVSFLGVLVVFLLFMNLYIEDSYVLEGDKQLIRETSTHQLNSERYVHTFKDLSNFSGTINVTYRYLAATPLQRKRYLTIGLSSVKRKKGNYLLDTIKSIFEQSSYEELKEISVVVHLADFNSSWRDAMVQDITQKFAHHIIAGRLMVIHAPEEYYPVLDGLKRNYNDPEDRVRFRSKQNVDYAFLLNFCANTSDYYVMLEDDVRCSRNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASFYTNMNVFENYEASKAYSSVDEYFWGKSPSMGDTFVIVFENPITIKKIKVNTGTEDRQNDILQHGALDVGEKLIFSKQIRQCDTYLRLGEFKNGYFEMSDVNQKIPFDIHCMRICVTKTQKEWLIIRSISIWTS

SEQ ID NO: 150 - protein, 478 aa, Sus scrofa
  PEPTIDE (1)...(478): pig N-acetylglucosaminyltransferase (GnT-IV)
MFKFHQVKHIFEILDKMRCLRKRFTVSFLGVLVIFLLFMNLYIEDSYVLEGDKQLVRETSIHQLNPERYVHTFKYLSNFSGTINVTYRYLAVMPFQRKRFLTIGLSSVRRKKGNYLLETIKSIFEQSSYEELKEISVVVHLADFNSSWREVMVQDITQKFAHHIIAGRLMVIHAPEEYYPVLNGLKRNYNDPEDRVRFRSKQNVDYAFLLNFCANISDYYVMLEDDVRCSKNFLTAIKKVITSLQGTYWVTLEFSKLGYIGKLYHSHDLPRLAHFLLMFYQEMPCDWLLTHFRGLLAQKNVIRFKPSLFQHMGYYSSYKGTENKLKDDDFEEELIDLPDNPPASLYTNMSVFENYDASKAYSSVDGYFWGKPPSTGDVFVVVFENPVIIKKIKVSTGTEDRQNDILHHGALDVGGYIRYFKQNRQCITYIRLGEFKNGNFEVSDVNQKIPFDVHCMRIHVTKTQKEWLIIRSISIWTS

SEQ ID NO: 151 - protein, 535 aa, Homo sapiens
  PEPTIDE (1)...(535): human N-acetylglucosaminyltransferase 4a (GnT-IVa)
MRLRNGTVATALAFITSFLTLSWYTTWQNGKEKLIAYQREFLALKERLRIAEHRISQRSSELNTIVQQFKRVGAETNGSKDALNKFSDNTLKLLKELTSKKSLQVPSIYYHLPHLLKNEGSLQPAVQIGNGRTGVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEIHIKKATN

SEQ ID NO: 152 - protein, 535 aa, Mus musculus [sequence omitted]

SEQ ID NO: 153 - protein, 548 aa, Homo sapiens
  PEPTIDE (1)...(548): human N-acetylglucosaminyltransferase 4b (GnT-IVb)
MRLRNGTFLTLLLFCLCAFLSLSWYAALSGQKGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 154 - protein, 548 aa, Mus musculus
  PEPTIDE (1)...(548): mouse N-acetylglucosaminyltransferase 4b (GnT-IVb)
MRLRNGTFLTLLLFCLCAFLSLSWYAALSGQKGDVVDIYQREFLALRDRLHAAEQESLKRSKELNLVLEEIKRAVSERQALRDGEGNRTWGRLTEDPRLKPWNVSHRHVLHLPTVFHHLPHLLAKESSLQPAVRVGQGRTGVSVVMGIPSVRREVHSYLTDTLHSLISELSPQEKEDSVIVVLIAETDPQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKHALRKEHVNPPAEVSTSLKTYQHFTLEKAYLREDFFWAFTPAAGDFIRFRFFQPLRLERFFFRSGNIEHPEDKLFNTSVEVLPFDNPQSEKEALQEGRSATLRYPRSPDGYLQIGSFYKGVAEGEVDPAFGPLEALRLSIQTDSPVWVILSEIFLKKAD

SEQ ID NO: 155 - protein, 741 aa, Homo sapiens
  PEPTIDE (1)...(741): human N-acetylglucosaminyltransferase 5 (GnT-V)
MALFTPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVVNGTGTNSTNSTTAVPSLVALEKINVADIINGAQEKCVLPPMDGYPHCEGKIKWMKDMWRSDPCYADYGVDGSTCSFFIYLSEVENWCPHLPWRAKNPYEEADHNSLAEIRTDFNILYSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNQEEVEDAVKAILNQKIEPYMPYEFTCEGMLQRINAFIEKQDFCHGQVMWPPLSALQVKLAEPGQSCKQVCQESQLICEPSFFQHLNKDKDMLKYKVTCQSSELAKDILVPSFDPKNKHCVFQGDLLLFSCAGAHPRHQRVCPCRDFIKGQVALCKDCL

SEQ ID NO: 156 - protein, 740 aa, Mus musculus
  PEPTIDE (1)...(740): mouse N-acetylglucosaminyltransferase 5 (GnT-V)
MAFFSPWKLSSQKLGFFLVTFGFIWGMMLLHFTIQQRTQPESSSMLREQILDLSKRYIKALAEENRDVVDGPYAGVMTAYDLKKTLAVLLDNILQRIGKLESKVDNLVNGTGANSTNSTTAVPSLVSLEKINVADIINGVQEKCVLPPMDGYPHCEGKIKWMKDMWRSDPCYADYGVDGTSCSFFIYLSEVENWCPRLPWRAKNPYEEADHNSLAEIRTDFNILYGMMKKHEEFRWMRLRIRRMADAWIQAIKSLAEKQNLEKRKRKKILVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHASYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNREEVEDAVKAILNQKIEPYMPYEFTCEGMLQRINAFIEKQDFCHGQVMWPPLSALQVKLAEPGQSCKQVCQESQLICEPSFFQHLNKEKDLLKYKVTCQSSELYKDILVPSFYPKSKHCVFQGDLLLFSCAGAHPTHQRICPCRDFIKGQVALCKDCL

SEQ ID NO: 157 - protein, 740 aa, Rattus norvegicus
  PEPTIDE (1)...(740): rat N-acetylglucosaminyltransferase 5 (GnT-V)
MAFFSPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVNGTGANSTNSTTAVPSLVSLEKINVADIINGVQEKCVLPPMDGYPHCEGKIKWMKDMWRSDPCYADYGVDGTSCSFFIYLSEVENWCPRLPWRAKNPYEEADHNSLAEIRTDFNILYGMMKKHEEFRWMRLRIRRMADAWIQAIKSLAEKQNLEKRKRKKILVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHASYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNREEVEDAVKAILNQKIEPYMPYEFTCEGMLQRINAFIEKQDFCHGQVMWPPLSALQVKLAEPGQSCKQVCQESQLICEPSFFQHLNKEKDLLKYKVICQSSELYKDILVPSFYPKSKHCVFQGDLLLFSCAGAHPTHQRICPCRDFIKGQVALCKDCL

SEQ ID NO: 158 - protein, 464 aa, Gallus gallus
  PEPTIDE (1)...(464): chicken N-acetylglucosaminyltransferase 6 (GnT-VI)
MRCSPKRSLTAVIAASFLLLLLLLLLHRGSWQDPQEVQFRDLPSDAVLKILKQGSLHILQDTDNLCALHNISYHLLAGSPLPHKKFLAVGLSSVRRPRGYYLPDTLQSLFKQSSEEELQEMVVVVHLADADPIWNAQVAADISHRFAHHILLGRLVLIHTPHEFYPTLEGLKRNYNDPEERVKFRSKQNVDYAFLFTFAANLSSYYLMIEDDVWSAKSFFTAIRKAVASQEGSNWATLEFSKLGYIGKLYRSSDLPRLARFLLLFYQEMPCDWLLTHFRLLLTQKDVIRFKPSLFQHMGLYSSFQGTVNRLEDDEFQADAMDLPDNPPAALFTNMVVFENYEPSKAYSTARGYFWGKNPAVGSIFSIVFHQPARVTRVRVQTGSSERPGDFLHAGVLELGRGRRADGRDCSVYTTVGTFEKGNLEWRGLEKGMPNPVECVRIRVTQSQSEWLIIQSIGIWTAGT

SEQ ID NO: 159 - protein, 478 aa, Homo sapiens
  PEPTIDE (1)...(478): human beta-1,4-N-acetylglucosaminyltransferase IV (GNTIVH)
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTGTEDRQNDILHHGALDVGENVMPSKQRRQCSSYLRLGEFKNGNFEMSGVNQKIPFDIHCMRIYVTKTQKEWLIIRSISIWTS

SEQ ID NO: 160 - protein, 478 aa, Sus scrofa; identical to SEQ ID NO: 150
  PEPTIDE (1)...(478): pig beta-1,4-N-acetylglucosaminyltransferase IV (GnT-IV, GNTIVH)

SEQ ID NO: 161 - protein, 324 aa, Homo sapiens
  PEPTIDE (1)...(324): human dolichyl-phosphate beta-glucosyltransferase (ALG5)
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 162 - protein, 260 aa, Homo sapiens
  PEPTIDE (1)...(260): human dolichyl-phosphate mannosyltransferase polypeptide 1 (Dpm1)
MASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHPKFIPEFIRKQKEGNFDIVSGTRYKGNGGVYGWDLKRKIISRGANFLTQILLRPGASDLTGSFRLYRKEVLEKLIEKCVSKGYVFQMEMIVRARQLNYTIGEVPISFVDRVYGESKLGGNEIVSFLKGLLTLFATT

SEQ ID NO: 163 - protein, 488 aa, Homo sapiens
  PEPTIDE (1)...(488): human alpha-1,6-mannosyltransferase (ALG12)
MAGKGSSGRRPLLLGLLVAVATVHLVICPYTKVEESFNLQATHDLLYHWQDLEQYDHLEFPGVVPRTFLGPVVIAVFSSPAVYVLSLLEMSKFYSQLIVRGVLGLGVIFGLWTLQKEVRRHFGAMVATMFCWVTAMQFHLMFYCTRTLPNVLALPVVLLALAAWLRHEWARFIWLSAFAIIVFRVELCLFLGLLLLLALGNRKVSVVRALRHAVPAGILCLGLTVAVDSYFWRQLTWPEGKVLWYNTVLNKSSNWGTSPLLWYFYSALPRGLGCSLLFIPLGLVDRRTHAPTVLALGFMALYSLLPHKELRFIIYAFPMLNITAARGCSYLLNNYKKSWLYKAGSLLVIGHLVVNAAYSATALYVSHFNYPGGVAMQRLHQLVPPQTDVLLHIDVAAAQTGVSRFLQVNSAWRYDKREDVQPGTGMLAYTHILMEAAPGLLALYRDTHRVLASVVGTTGVSLNLTQLPPFNVHLQTKLVLLERLPRPS

SEQ ID NO: 164 - protein, 438 aa, Homo sapiens
  PEPTIDE (1)...(438): human alpha-1,3-mannosyltransferase (ALG3)
MAAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 165 - protein, 464 aa, Homo sapiens
  PEPTIDE (1)...(464): human beta-1,4-mannosyltransferase (HMT1/ALG1)
MAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 166 - protein, 416 aa, Homo sapiens
  PEPTIDE (1)...(416): human alpha-1,3-mannosyltransferase (ALG2)
MAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 167 - protein, 388 aa, Homo sapiens
  PEPTIDE (1)...(388): human peptide-O-fucosyltransferase 1 (POFUT1)
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 168 - protein, 391 aa, Bos taurus
  PEPTIDE (1)...(391): cow peptide-O-fucosyltransferase 1 (pofut1)
MGAAAWAPSLLPPRVSLLLLLLPLPGLPVGSWDPAGYLLYCPCMGRFGNQADHFLGSLAFAKLLNRTLAVPPWIEYQHHKPPFTNVHVSYQKYFKLEPLQAYHRVISLEDFMEKLAPTHWPPEKRVAYCFEVAAQRSPDKKTCPMKEGNPFGPFWDQFHVSFNKSELFAGISFSASYKDQWIQRFSPEEHPVLALPGAPAQFPVLEEHRPLQKYMVWSDEMVRTGEAQIHAHLIRPYVGIHLRIGSDWKNACAMLKDGTAGAHFMASPQCVGYSRHTTAPLTMTMCLPDLKEIRRALKLWVTALNAQSVYIATDSESYLPEIQQLFKGKVKVVSLKPEVAQIDLYILGQADHFIGNCVSSFTAFVKRERDLHGRPSSFFGMDRPPQLRDEF

SEQ ID NO: 169 - protein, 393 aa, Mus musculus
  PEPTIDE (1)...(393): mouse peptide-O-fucosyltransferase 1 (pofut1)
MGAAAWAPPHLLLRASFLLLLLLLPLRGRSAGSWDLAGYLLYCPCMGRFGNQADHFLGSLAFAKLLNRTLAVPPWIEYQHHKPPFTNLHVSYQKYFKLEPLQAYHRVVSLEDFMENLAPSHWPPEKRVAYCFEVAAQRSPDKKTCPMKEGNPFGPFWDQFHVSFNKSELFTGISFSASYKEQWTQRFPAKEHPVLALPGAPAQFPVLEEHRELQKYMVWSDEMVRTGEALISAHLVRPYVGIHLRIGSDWKNACAMLKDGTAGSHFMASPQCVGYSRSTATPLTMTMCLPDLKEIQRAVTLWVRALNARSVYIATDSESYVSEIQQLFKDKVRVVSLKPEVAQIDLYILGQADHFIGNCVSSFTAFVKRERDLHGRQSSFFGMDRPSQLRDEF

SEQ ID NO: 170 - protein, 378 aa, Homo sapiens
  PEPTIDE (1)...(378): pig peptide-O-fucosyltransferase 1 (POFUT1) (truncated)
SSPLPPLVSLLLLLLPLPGLPAVSWDPAGYLLYCPCMGRFGNQADHFLGSLAFAKLLNRTLAVPPWIEYQHHKPPFTNLHVSYQKYFKLEPLQVYHRVISLEDFMEKLAPTHWPPERRVAYCFEVAAQRSPDKKTCPMKEGNPFGPFWDQFHVSFNKSELFAGISFSASYKDQWIQRFSPKEHPVLALPGAPAQFPVLEEHRPLQKYMVWSDEMVRTGEAQIRAHLIRPYVGIHLRIGSDWKNACAMLKDGTAGAHFMASPQCVGYSRHTAAPLTMTMCLPDLKEIRRALKLWVTALSAQSVYIATDSESYLPEIQQLFKGKVKVVSLKPEVAQIDLYILGQADHFIGNCVSSFTAFVKRERDLQGRLSSFFGMDRPP

SEQ ID NO: 171 - protein, 321 aa, Homo sapiens
  PEPTIDE (1)...(321): human beta-1,3-N-acetylglucosaminyltransferase, maniac fringe
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 172 - protein, 660 aa, Homo sapiens
  PEPTIDE (1)...(660): human beta-1,2-N-acetylglucosaminyltransferase (MGNT1)
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 173 - protein, 1046 aa, Homo sapiens
  PEPTIDE (1)...(1046): human O-linked N-acetylglucosamine transferase (OGT1)
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 174 - protein, 1046 aa, Mus musculus
  PEPTIDE (1)...(1046): mouse O-linked N-acetylglucosamine transferase (Ogt)
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVAEQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNPDSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKSRQEYEDIAVKLGTDLEYLKKIRGKVWKQRISSPLFNTKQYTMELERLYLQMWEHYAAGNKPDHMIKPVEVTESA

SEQ ID NO: 175 - protein, 1036 aa, Rattus norvegicus
  PEPTIDE (1)...(1036): rat O-linked N-acetylglucosamine transferase (Ogt)
MASSVGNVADSTGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVAEQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADTTNTALNMPVIPMNTIAEAVIEMINRGQIQITINGFSISNGLATTQINNKAATGEEVPRTIIVTTRSQYGLPEDAIVYCNFNQLYKIDPSTLQMGANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKSRQEYEDIAVKLGTDLEYLKKIRGKVWKQRISSPLFNTKQYTMELERLYLQMWEHYAAGNKPDHMIKPVEVTESA

SEQ ID NO: 176 - protein, 638 aa, Escherichia coli
  PEPTIDE (1)...(638): dnaK, HSP-70-type molecular chaperone, heat-inducible
MGKIIGIDLGTTNSCVAIMDGTTPRVLENAEGDRTTPSIIAYTQDGETLVGQPAKRQAVTNPQNTLFAIKRLIGRRFQDEEVQRDVSIMPFKIIAADNGDAWVEVKGQKMAPPQISAEVLKKMKKTAEDYLGEPVTEAVITVPAYFNDAQRQATKDAGRIAGLEVKRIINEPTAAALAYGLDKGTGNRTIAVYDLGGGTFDISIIEIDEVDGEKTFEVLATNGDTHLGGEDFDSRLINYLVEEFKKDQGIDLRNDPLAMQRLKEAAEKAKIELSSAQQTDVNLPYITADATGPKHMNIKVTRAKLESLVEDLVNRSIEPLKVALQDAGLSVSDIDDVILVGGQTRMPMVQKKVAEFFGKEPRKDVNPDEAVAIGAAVQGGVLTGDVKDVLLLDVTPLSLGIETMGGVMTTLIAKNTTIPTKHSQVFSTAEDNQSAVTIHVLQGERKRAADNKSLGQFNLDGINPAPRGMPQIEVTFDIDADGILHVSAKDKNSGKEQKITIKASSGLNEDEIQKMVRDAEANAEADRKFEELVQTRNQGDHLLHSTRKQVEEAGDKLPADDKTAIESALTALETALKGEDKAAIEAKMQELAQVSQKLMEIAQQQHAQQQTAGADASANNAKDDDVVDAEFEEVKDKK

SEQ ID NO: 177 - protein, 857 aa, Escherichia coli
  PEPTIDE (1)...(857): EG10157 ClpB protease, ATP dependent
MRLDRLTNKFQLALADAQSLALGHDNQFIEPLHLMSALLNQEGGSVSPLLTSAGINAGQLRTDINQALNRLPQVEGTGGDVQPSQDLVRVLNLCDKLAQKRGDNFISSELFVLAALESRGTLADILKAAGATTANITQAIEQMRGGESVNDQGAEDQRQALKKYTIDLTERAEQGKLDPVIGRDEEIRRTIQVLQRRTKNNPVLIGEPGVGKTAIVEGLAQRIINGEVPEGLKGRRVLALDMGALVAGAKYRGEFEERLKGVLNDLAKQEGNVILFIDELHTMVGAGKADGAMDAGNMLKPALARGELHCVGATTLDEYRQYIEKDAALERRFQKVFVAEPSVEDTIAILRGLKERYELHHHVQITDPAIVAAATLSHRYIADRQLPDKAIDLIDEAASSIRMQIDSKPEELDRLDRRIIQLKLEQQALMKESDEASKKRLDMLNEELSDKERQYSELEEEWKAEKASLSGTQTIKAELEQAKIAIEQARRVGDLARMSELQYGKIPELEKQLEAATQLEGKTMRLLRNKVTDAEIAEVLARWTGIPVSRMMESEREKLLRMEQELHHRVIGQNEAVDAVSNAIRRSRAGLADPNRPIGSFLFLGPTGVGKTELCKALANFMFDSDEAMVRIDMSEFMEKHSVSRLVGAPPGYVGYEEGGYLTEAVRRRPYSVILLDEVEKAHPDVFNILLQVLDDGRLTDGQGRTVDFRNTVVIMTSNLGSDLIQERFGELDYAHMKELVLGVVSHNFRPEFINRIDEVVVFHPLGEQHIASIAQIQLKRLYKRLEERGYEIHISDEALKLLSENGYDPVYGARPLKRAIQQQIENPLAQQILSGELVPGKVIRLEVNEDRIVAVQ

SEQ ID NO: 178 - protein, 540 aa, Escherichia coli
  PEPTIDE (1)...(540): GroEL
AAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGM

SEQ ID NO: 179 - protein, 97 aa, Oleispira antarctica
  PEPTIDE (1)...(97): Cpn10
MKIRPLHDRIVVRRKEEETATAGGIILPGAAAEKPNQGVVISVGTGRILDNGSVQALAVNEGDVVVFGKYSGQNTIDIDGEELLILNESDIYGVLEA

SEQ ID NO: 180 - protein, 548 aa, Oleispira antarctica
  PEPTIDE (1)...(548): Cpn 60
MAAKDVLFGDSARAKMLVGVNILADAVRVTLGPKGRNVVIEKSFGAPIITKDGVSVAREIELKDKFENMGAQMVKEVASQANDQAGDGTTTATVLAQAIISEGLKSVAAGMNPMDLKRGIDKATAAVVAAIKEQAQPCLDTKAIAQVGTISANADETVGRLIAEAMEKVGKEGVITVEEGKGLEDELDVVEGMQFDRGYLSPYFINNQEKMTVEMENPLILLVDKKIDNLQELLPILENVAKSGRPLLIVAEDVEGQALATLVVNNLRGTFKVAAVKAPGFGDRRKAMLQDLAILTGGQVISEELGMSLETADPSSLGTASKVVIDKENTVIVDGAGTEASVNTRVDQIRAEIESSTSDYDIEKLQERVAKLAGGVAVIKVGAGSEMEMKEKKDRVDDALHATRAAVEEGVVAGGGVALIRALSSVTVVGDNEDQNVGIALALRAMEAPIRQIAGNAGAEGSVVVDKVKSGTGSFGFNASTGEYGDMIAMGILDPAKVTRSSLQAAASIAGLMITTEAMVADAPVEEGAGGMPDMGGMGGMGGMPGMM

SEQ ID NO: 181 - protein, 509 aa, Rattus norvegicus
  PEPTIDE (1)...(509): rat PDI protein, PDIA1_RAT
MLSRALLCLALAWAARVGADALEEEDNVLVLKKSNFAEALAAHNYLLVEFYAPWCGHCKALAPEYAKAAAKLKAEGSEIRLAKVDATEESDLAQQYGVRGYPTIKFFKNGDTASPKEYTAGREADDIVNWLKKRTGPAATTLSDTAAAESLVDSSEVTVIGFFKDAGSDSAKQFLLAAEAVDDIPFGITSNSDVFSKYQLDKDGVVLFKKFDEGRNNFEGEITKEKLLDFIKHNQLPLVIEFTEQTAPKIFGGEIKTHILLFLPKSVSDYDGKLSNFKKAAEGFKGKILFIFIDSDHTDNQRILEFFGLKKEECPAVRLITLEEEMTKYKPESDELTAEKITQFCHHFLEGKIKPHLMSQELPEDWDKQPVKVLVGKNFEEVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDNDDLDLEEALEPDMEEDDDQKAVKDEL

SEQ ID NO: 182 - protein, 563 aa, Saccharomyces sp.
  PEPTIDE (1)...(563): Ero1p
MRLRTAIATLCLTAFTSATSNNSYIATDQTQNAFNDTHFCKVDRNDHVSPSCNVTFNELNAINENIRDDLSALLKSDFFKYFRLDLYKQCSFWDANDGLCLNRACSVDVVEDWDTLPEYWQPEILGSFNNDTMKEADDSDDECKFLDQLCQTSKKPVDIEDTINYCDVNDFNGKNAVLIDLTANPERFTGYGGKQAGQIWSTIYQDNCFTIGETGESLAKDAFYRLVSGFHASIGTHLSKEYLNTKTGKWEPNLDLFMARIGNFPDRVTNMYFNYAVVAKALWKIQPYLPEFSFCDLVNKEIKNKMDNVISQLDTKIFNEDLVFANDLSLTLKDEFRSRFKNVTKIMDCVQCDRCRLWGKIQTTGYATALKILFEINDADEFTKQHIVGKLTKYELIALLQTFGRLSESIESVNMFEKMYGKRLNGSENRLSSFFQNNFFNILKEAGKSIRYTIENINSTKEGKKKTNNSQSHVFDDLKMPKAEIVPRPSNGTVNKWKKAWNTEVNNVLEAFRFIYRSYLDLPRNIWELSLMKVYKFWNKFIGVADYVSEETREPISYKLDIQ

SEQ ID NO: 183 - protein, 701 aa, Saccharomyces sp.
  PEPTIDE (1)...(701): Pdi1p, YIL005W
MKMNLKRLVVTFFSCITFLLKFTIAAAEPPEGFPEPLNPTNFKEELSKGLHIIDFYSPYCPHCKHLAPVWMETWEEFKEESKTLNITFSQVNCIESADLCGDENIEYFPEIRLYNPSGYIKSFTETPRTKESLIAFARRESMDPNNLDTDLDSAKSESQYLEGFDFLELIAGKATRPHLVSFWPTKDMKNSDDSLEFKNCDKCHEFQRTWKIISRQLAVDDINTGHVNCESNPTICEELGFGDLVKITNHRADREPKVALVLPNKTSNNLFDYPNGYSAKSDGYVDFARRTFTNSKFPNITEGELEKKANRDIDFLQERGRVTNNDIHLVFSYDPETVVIEDFDILEYLIEPLSKIPNIYLHQIDKNLINLSRNLFGRMYEKINYDASQTQKVFNKEYFTMNTVTQLPTFFMFKDGDPISYVFPGYSTTEMRNIDAIMDWVKKYSNPLVTEVDSSNLKKLISFQTKSYSDLAIQLISSTDHKHIKGSNKLIKNLLLASWEYEHIRMENNFEEINERRARKADGIKKIKEKKAPANKIVDKMREEIPHMDQKKLLLGYLDISKEKNFFRKYGITGEYKIGDVIIIDKSNNYYYNKDNFGNSLTSNNPQLLREAFVSLNIPSKALYSSKLKGRLINSPFHNVLSFLDIIHGNGMPGYLIVIVLFIAILKGPSIYRRYKVRKHYRAKRNAVGILGNMEKKKNQD

SEQ ID NO: 184 - protein, 176 aa, Escherichia coli
  PEPTIDE (1)...(176): DsbB protein
MLRFLNQCSQGRGAWLLMAFTALALELTALWFQHVMLLKPCVLCIYERCALFGVLGAALIGAIAPKTPLRYVAMVIWLYSAFRGVQLTYEHTMLQLYPSPFATCDFMVRFPEWLPLDKWVPQVFVASGDCAERQWDFLGLEMPQWLLGIFIAYLIVAVLVVISQPFKAKKRDLFGR

SEQ ID NO: 185 - protein, 208 aa, Escherichia coli
  PEPTIDE (1)...(208): DsbA protein
MKKIWLALAGLVLAFSASAAQYEDGKQYTTLEKPVAGAPQVLEFFSFFCPHCYQFEEVLHISDNVKKKLPEGVKMTKYHVNFMGGDLGKDLTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYADTVKYLSEKK

SEQ ID NO: 186 - protein, 236 aa, Escherichia coli
  PEPTIDE (1)...(236): DsbC protein
MKKGFMLFTLLAAFSGFAQADDAAIQQTLAKMGIKSSDIQPAPVAGMKTVLTNSGVLYITDDGKHIIQGPMYDVSGTAPVNVTNKMLLKQLNALEKEMIVYKAPQEKHVITVFTDITCGYCHKLHEQMADYNALGITVRYLAFPRQGLDSDAEKEMKAIWCAKDKNKAFDDVMAGKSVAPASCDVDIADHYALGVQLGVSGTPAVVLSNGTLVPGYQPPKEMKEFLDEHQKMTSGK

SEQ ID NO: 187 - protein, 565 aa, Escherichia coli
  PEPTIDE (1)...(565): DsbD protein
MAQRIFTLILLLCSTSVFAGLFDAPGRSQFVPADQAFAFDFQQNQHDLNLTWQIKDGYYLYRKQIRITPEHAKIADVQLPQGVWHEDEFYGKSEIYRDRLTLPVTINQASAGATLTVTYQGCADAGFCYPPETKTVPLSEVVANNAAPQPVSVPQQEQPTAQLPFSALWALLIGIGIAFTPCVLPMYPLISGIVLGGKQRLSTARALLLTFIYVQGMALTYTALGLVVAAAGLQFQAALQHPYVLIGLAIVFTLLAMSMFGLFTLQLPSSLQTRLTLMSNRQQGGSPGGVFVMGAIAGLICSPCTTAPLSAILLYIAQSGNMWLGGGTLYLYALGMGLPLMLITVFGNRLLPKSGPWMEQVKTAFGFVILALPVFLLERVIGDVWGLRLWSALGVAFFGWAFITSLQAKRGWMRIVQIILLAAALVSVRPLQDWAFGATHTAQTQTHLNFTQIKTVDELNQALVEAKGKPVMLDLYADWCVACKEFEKYTFSDPQVQKALADTVLLQANVTANDAQDVALLKHLNVLGLPTILFFDGQGQEHPQARVTGFMDAETFSAHLRDRQP

SEQ ID NO: 188 - protein, 268 aa, Escherichia coli
  PEPTIDE (1)...(268): DsbG protein
MTVIGYAFYSTFALTEKDKLMLKKILLLALLPAIAFAEELPAPVKAIEKQGITIIKTFDAPGGMKGYLGKYQDMGVTIYLTPDGKHAISGYMYNEKGENLSNTLIEKEIYAPAGREMWQRMEQSHWLLDGKKDAPVIVYVFADPFCPYCKQFWQQARPWVDSGKVQLRTLLVGVIKPESPATAAAILASKDPAKTWQQYEASGGKLKLNVPANVSTEQMKVLSDNEKLMDDLGANVTPAIYYMSKENTLQQAVGLPDQKTLNIIMGNK

SEQ ID NO: 189 - protein, 519 aa, Artificial Sequence
  truncated human UDP-N-acetylgalactosaminyltransferase 1 (GalNAc-T1 delta40)
GLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 190 - protein, 520 aa, Artificial Sequence
  truncated human UDP-N-acetylgalactosaminyltransferase 1 (GalNAc-T1 delta40) alternate form
MGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 191 - protein, 914 aa, Artificial Sequence
  maltose binding protein-tagged truncated human UDP-N-acetylgalactosaminyltransferase 1 (MBP-GalNAc-T1 delta40)
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSHMGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 192 - protein, 518 aa, Artificial Sequence
  truncated human UDP-N-acetylgalactosaminyltransferase 2 (GalNAc-T2 delta53)
KDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 193 - protein, 391 aa, Artificial Sequence
  truncated human UDP-N-acetylgalactosaminyltransferase 2 (GalNAc-T2 delta1-53 delta445-571)
KDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQD

SEQ ID NO: 194 - protein, 520 aa, Artificial Sequence
  truncated human UDP-N-acetylgalactosaminyltransferase 2 (GalNAc-T2 delta53) alternate form
MSKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 195 - protein, 393 aa, Artificial Sequence
  truncated human UDP-N-acetylgalactosaminyltransferase 2 (GalNAc-T2 delta1-53 delta445-571) alternate form
MSKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQD

SEQ ID NO: 196 - protein, 914 aa, Artificial Sequence [sequence omitted]

SEQ ID NO: 197 - protein, 914 aa, Artificial Sequence [sequence omitted]

SEQ ID NO: 198 - protein, 357 aa, Drosophila sp.
  PEPTIDE (1)...(357): Drosophila UDP-galactose:N-acetylgalactosamine-alpha-R beta-1,3-galactosyltransferase (Core-1-Gal-T1 delta31) (truncated)
GFCLAELFVYSTPERSEFMPYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSAETKTQ

SEQ ID NO: 199 - protein, 752 aa, Artificial Sequence
  maltose binding protein-tagged truncated Drosophila UDP-galactose:N-acetylgalactosamine-alpha-R beta-1,3-galactosyltransferase (MBP-Core-1-Gal-T1 delta31) A383T mutant
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSHMGFCLAELFVYSTPERSEFMPYDGHRHGDVNDAHHSHDMMEMSGPEQDVGGHEHVHENSTIAERLYSEVRVLCWIMTNPSNHQKKARHVKRTWGKRCNKLIFMSSAKDDELDAVALPVGEGRNNLWGKTKEAYKYIYEHHINDADWFLKADDDTYTIVENMRYMLYPYSPETPVYFGCKFKPYVKQGYMSGGAGYVLSREAVRRFVVEALPNPKLCKSDNSGAEDVEIGKCLQNVNVLAGDSRDSNGRGRFFPFVPEHHLIPSHTDKKFWYWQYIFYKTDEGLDCCSDNAISFHYVSPNQMYVLDYLIYHLRPYGIINTPDALPNKLAVGELMPEIKEQATESTSDGVSKRSTETKTQ

SEQ ID NO: 200 - protein, 786 aa, Artificial Sequence
  maltose binding protein-tagged truncated human UDP-N-acetylgalactosaminyltransferase 2 (GalNAc-T2 delta1-51 delta445-571)
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFGSKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQD

SEQ ID NO: 201 - protein, 8 aa, Artificial Sequence
  "FLAG tag" epitope tag, anti-FLAG antibody epitope
DYKDDDDK

SEQ ID NO: 202 - protein, 5 aa, Artificial Sequence
  DDDK (EC5) epitope tag
DDDDK

SEQ ID NO: 203 - protein, 6 aa, Artificial Sequence
  6 residue peptide epitope tag derived from Polyoma middle T protein
EYMPME

SEQ ID NO: 204 - protein, 6 aa, Artificial Sequence
  hexahistidine epitope tag, purification tag, metal chelate affinity ligand
HHHHHH

What is claimed is:

1. A method of producing a soluble truncated active eukaryotic glycosyltransferase in a prokaryotic microorganism, which method comprising the steps of
   (a) providing a prokaryotic microorganism that has an oxidizing intracellular environment,
   (b) expressing a nucleic acid that encodes a truncated eukaryotic glycosyltransferase in the prokaryotic microorganism, wherein the truncated eukaryotic glycosyltransferase is a truncated human GalNacT2 of SEQ ID NO: 33 having a truncation selected from the group consisting of Δ51 Δ445, or one or two truncations selected from the group consisting of Δ40, Δ53, Δ73, Δ94, and Δ445, and
   (c) growing the microorganism under conditions that allow expression of the soluble truncated active eukaryotic glycosyltransferase within a cellular compartment of the prokaryotic microorganism.

2. The method of claim 1, wherein the truncated human GalNacT2 is selected from the group consisting of, human GalNAcT2 (Δ40), human GalNAcT2(Δ73), human GalNAcT2(Δ94), human GalNAcT2 (Δ51Δ445), human GalNAcT2(Δ53), and human GalNAcT2(Δ53Δ445).

3. A method of producing a soluble active eukaryotic glycosyltransferase fusion protein in a prokaryotic microorganism, which method comprises:
   (a) providing a prokaryotic microorganism that has an oxidizing intracellular environment,
   (b) expressing a nucleic acid that encodes a soluble active eukaryotic glycosyltransferase fusion protein which comprises a maltose binding protein (MBP) and a truncated eukaryotic glycosyltransferase, wherein the truncated eukaryotic glycosyltransferase is a truncated human GalNAcT2 of SEQ ID NO: 33 having a truncation selected from the group consisting of Δ51Δ445, or one or two truncations selected from the group consisting of Δ40, Δ53, Δ73, Δ94, and Δ445, in the prokaryotic microorganism, and
   (c) growing the microorganism under conditions that allow expression of the soluble active eukaryotic glycosyltransferase fusion protein within a cellular compartment of the prokaryotic microorganism.

4. The method of claim 3, wherein the soluble active eukaryotic glycosyltransferase fusion protein is an O-linked glycan glycosyltransferase fusion protein having human MBP-GalNAc-T2 (Δ51, Δ445).

5. The method of claim 4, wherein the soluble active human MBP-GalNAc-T2 (Δ51, Δ445) has an enzyme activity of about 5 U/L.

* * * * *